(12) United States Patent
Bitter et al.

US010253086B2

(10) Patent No.: US 10,253,086 B2
(45) Date of Patent: Apr. 9, 2019

(54) CD20 THERAPIES, CD22 THERAPIES, AND COMBINATION THERAPIES WITH A CD19 CHIMERIC ANTIGEN RECEPTOR (CAR)-EXPRESSING CELL

(71) Applicants: Novartis AG, Basel (CH); The Trustees of the University of Pennsylvania, Philadelphia, PA (US)

(72) Inventors: Hans Bitter, Cambridge, MA (US); Jennifer Mary Bordeaux, Carlsbad, CA (US); Barbara Brannetti, Basel (CH); Jennifer Brogdon, Cambridge, MA (US); Naveen Kumar Dakappagari, Carlsbad, CA (US); Saar Gill, Philadelphia, PA (US); Steven Highfill, Bethesda, MD (US); Lu Huang, Cambridge, MA (US); Carl H. June, Merion Station, PA (US); Ju Young Kim, Carlsbad, CA (US); Ming Lei, Cambridge, MA (US); Na Li, Cambridge, MA (US); Andreas Loew, Cambridge, MA (US); Elena Orlando, Cambridge, MA (US); Marco Ruella, Philadelphia, PA (US); Thai Tran, Carlsbad, CA (US); Jimin Zhang, Cambridge, MA (US); Li Zhou, Cambridge, MA (US)

(73) Assignees: Novartis AG, Basel (CH); The Trustees of the University of Pennsylvania, Philadelphia, PA (US)

( * ) Notice: Subject to any disclaimer, the term of this patent is extended or adjusted under 35 U.S.C. 154(b) by 7 days.

(21) Appl. No.: 15/094,674

(22) Filed: Apr. 8, 2016

(65) Prior Publication Data
US 2016/0362472 A1    Dec. 15, 2016

Related U.S. Application Data

(60) Provisional application No. 62/263,423, filed on Dec. 4, 2015, provisional application No. 62/207,255, filed on Aug. 19, 2015, provisional application No. 62/144,615, filed on Apr. 8, 2015, provisional application No. 62/144,639, filed on Apr. 8, 2015, provisional application No. 62/144,497, filed on Apr. 8, 2015.

(51) Int. Cl.
| *A61K 38/00* | (2006.01) |
| *A61K 39/00* | (2006.01) |
| *A61K 45/06* | (2006.01) |
| *C07K 16/28* | (2006.01) |
| *C07K 14/705* | (2006.01) |
| *C07K 14/725* | (2006.01) |

(52) U.S. Cl.
CPC .... *C07K 14/70596* (2013.01); *A61K 39/0011* (2013.01); *A61K 45/06* (2013.01); *C07K 14/7051* (2013.01); *C07K 16/2803* (2013.01); *C07K 16/2866* (2013.01); *A61K 38/00* (2013.01); *A61K 2039/5156* (2013.01); *A61K 2039/5158* (2013.01); *A61K 2039/70* (2013.01); *C07K 2317/24* (2013.01); *C07K 2317/622* (2013.01); *C07K 2319/00* (2013.01)

(58) Field of Classification Search
None
See application file for complete search history.

(56) References Cited

U.S. PATENT DOCUMENTS

| 5,359,046 A | 10/1994 | Capon et al. |
| 5,686,281 A | 11/1997 | Roberts |
| 5,712,149 A | 1/1998 | Roberts |
| 5,786,464 A | 7/1998 | Seed |
| 5,874,240 A | 2/1999 | Ni et al. |
| 5,906,936 A | 5/1999 | Eshhar et al. |
| 6,103,521 A | 8/2000 | Capon et al. |
| 6,111,090 A | 8/2000 | Gorman et al. |
| 6,114,148 A | 9/2000 | Seed et al. |
| 6,319,494 B1 | 11/2001 | Capon et al. |
| 6,355,779 B1 | 3/2002 | Goodwin et al. |
| 6,410,319 B1 | 6/2002 | Raubitschek et al. |
| 6,569,997 B1 | 5/2003 | Kwon |
| 7,049,136 B2 | 5/2006 | Seed et al. |
| 7,052,906 B1 | 5/2006 | Lawson et al. |
| 7,070,995 B2 | 7/2006 | Jensen |
| 7,132,255 B2 | 11/2006 | Blumberg |
| 7,265,209 B2 | 9/2007 | Jensen |
| 7,319,143 B2 | 1/2008 | Gross et al. |
| 7,320,787 B2 | 1/2008 | Seed et al. |
| 7,402,431 B2 | 7/2008 | Har-Noy |
| 7,446,190 B2 | 11/2008 | Sadelain et al. |

(Continued)

FOREIGN PATENT DOCUMENTS

| EP | 215576 A1 | 3/1987 |
| EP | 0574512 A1 | 12/1993 |

(Continued)

OTHER PUBLICATIONS

Janeway et al. (Immunobiology 5, 2001, p. 100-101) (Year: 2001).*

(Continued)

*Primary Examiner* — Peter J Reddig
(74) *Attorney, Agent, or Firm* — Lando & Anastasi, LLP

(57) ABSTRACT

The invention provides compositions and methods for treating diseases associated with expression of CD19, e.g., by administering a recombinant T cell comprising the CD19 CAR as described herein, in combination with one or more B-cell inhibitors, e.g., inhibitors of one or more of CD10, CD20, CD22, CD34, CD123, FLT-3, ROR1, CD79b, CD179b, or CD79a. The disclosure additionally features novel antigen binding domains and CAR molecules directed to CD20 and CD22, and uses, e.g., as monotherapies or in combination therapies. The invention also provides kits and compositions described herein.

35 Claims, 119 Drawing Sheets

Specification includes a Sequence Listing.

(56) References Cited

U.S. PATENT DOCUMENTS

| | | | |
|---|---|---|---|
| 7,446,191 B2 | 11/2008 | Jensen | |
| 7,514,537 B2 | 4/2009 | Jensen | |
| 7,638,325 B2 | 12/2009 | June et al. | |
| 7,638,326 B2 | 12/2009 | June et al. | |
| 7,741,465 B1 | 6/2010 | Eshhar et al. | |
| 7,745,140 B2 | 6/2010 | June et al. | |
| 7,754,482 B2 | 7/2010 | Riley et al. | |
| 7,994,298 B2 | 8/2011 | Zhang et al. | |
| 8,008,449 B2 | 8/2011 | Korman et al. | |
| 8,124,084 B2 | 2/2012 | Lefrancois et al. | |
| 8,211,422 B2 | 7/2012 | Eshhar et al. | |
| 8,252,914 B2 | 8/2012 | Zhang et al. | |
| 8,383,778 B2 | 2/2013 | Hsieh et al. | |
| 8,389,282 B2 | 3/2013 | Sadelain et al. | |
| 8,399,645 B2 | 3/2013 | Campana et al. | |
| 8,465,743 B2 | 6/2013 | Rosenberg et al. | |
| 8,637,307 B2 | 1/2014 | June et al. | |
| 8,722,400 B2 | 5/2014 | Riley et al. | |
| 8,906,682 B2 * | 12/2014 | June | A61K 35/17 435/328 |
| 8,911,993 B2 | 12/2014 | June et al. | |
| 8,916,381 B1 | 12/2014 | June et al. | |
| 8,975,071 B1 | 3/2015 | June et al. | |
| 9,101,584 B2 | 8/2015 | June et al. | |
| 9,102,760 B2 | 8/2015 | June et al. | |
| 9,102,761 B2 | 8/2015 | June et al. | |
| 9,394,368 B2 | 7/2016 | Brogdon et al. | |
| 9,464,140 B2 | 10/2016 | June et al. | |
| 9,481,728 B2 | 11/2016 | June et al. | |
| 9,499,629 B2 | 11/2016 | June et al. | |
| 9,573,988 B2 | 2/2017 | Brogdon et al. | |
| 9,745,368 B2 | 8/2017 | Milone et al. | |
| 9,765,156 B2 * | 9/2017 | June | C07K 16/468 |
| 9,777,061 B2 | 10/2017 | Ebersbach et al. | |
| 9,815,901 B2 | 11/2017 | Brogdon et al. | |
| 2003/0060444 A1 | 3/2003 | Finney et al. | |
| 2003/0077249 A1 | 4/2003 | Bebbington et al. | |
| 2003/0148982 A1 | 8/2003 | Brenner et al. | |
| 2003/0224520 A1 | 12/2003 | June et al. | |
| 2004/0038886 A1 | 2/2004 | Finney et al. | |
| 2004/0043401 A1 | 3/2004 | Sadelain et al. | |
| 2005/0113564 A1 | 5/2005 | Campana et al. | |
| 2005/0129671 A1 | 6/2005 | Cooper et al. | |
| 2007/0036773 A1 | 2/2007 | Cooper et al. | |
| 2008/0131415 A1 | 6/2008 | Riddell et al. | |
| 2009/0082299 A1 | 3/2009 | Felber et al. | |
| 2009/0136516 A1 | 5/2009 | Tedder et al. | |
| 2009/0257994 A1 | 10/2009 | Jensen | |
| 2010/0233200 A1 | 9/2010 | Medin | |
| 2010/0247521 A1 | 9/2010 | Jones et al. | |
| 2011/0052554 A1 | 3/2011 | Zakrzewski et al. | |
| 2011/0081311 A1 | 4/2011 | Pavlakis et al. | |
| 2011/0262440 A1 | 10/2011 | Zugmaier | |
| 2012/0141413 A1 | 6/2012 | Pavlakis et al. | |
| 2012/0148552 A1 | 6/2012 | Jensen | |
| 2012/0177598 A1 | 7/2012 | Lefrancois et al. | |
| 2012/0321667 A1 | 12/2012 | Sentman | |
| 2013/0071409 A1 | 3/2013 | Riley et al. | |
| 2013/0071414 A1 | 3/2013 | Dotti et al. | |
| 2013/0149337 A1 | 6/2013 | Cooper et al. | |
| 2013/0155909 A1 | 6/2013 | Jackson et al. | |
| 2013/0287748 A1 | 10/2013 | June et al. | |
| 2013/0288368 A1 | 10/2013 | June et al. | |
| 2014/0050708 A1 | 2/2014 | Powell et al. | |
| 2014/0099309 A1 | 4/2014 | Powell, Jr. et al. | |
| 2014/0099340 A1 | 4/2014 | June et al. | |
| 2014/0106449 A1 | 4/2014 | June et al. | |
| 2014/0186947 A1 | 7/2014 | June et al. | |
| 2014/0212446 A1 | 7/2014 | Riley et al. | |
| 2014/0219975 A1 | 8/2014 | June et al. | |
| 2014/0227237 A1 | 8/2014 | June et al. | |
| 2014/0271635 A1 | 9/2014 | Brogdon et al. | |
| 2014/0286934 A1 | 9/2014 | Blein et al. | |
| 2014/0322169 A1 | 10/2014 | Harper et al. | |
| 2014/0322183 A1 | 10/2014 | Milone et al. | |
| 2014/0322212 A1 | 10/2014 | Brogdon et al. | |
| 2014/0322275 A1 | 10/2014 | Brogdon et al. | |
| 2014/0370017 A1 | 12/2014 | June et al. | |
| 2014/0370045 A1 | 12/2014 | June et al. | |
| 2015/0017141 A1 | 1/2015 | June et al. | |
| 2015/0050729 A1 | 2/2015 | June et al. | |
| 2015/0093822 A1 | 4/2015 | June et al. | |
| 2015/0099299 A1 | 4/2015 | June et al. | |
| 2015/0118202 A1 | 4/2015 | June et al. | |
| 2015/0140019 A1 | 5/2015 | June et al. | |
| 2015/0190428 A1 | 7/2015 | June et al. | |
| 2015/0202286 A1 | 7/2015 | June et al. | |
| 2015/0283178 A1 | 10/2015 | June et al. | |
| 2015/0290244 A1 | 10/2015 | June et al. | |
| 2015/0342994 A1 | 12/2015 | Riley et al. | |
| 2016/0046724 A1 | 2/2016 | Brogdon et al. | |
| 2016/0051651 A1 | 2/2016 | Brogdon et al. | |
| 2016/0068601 A1 | 3/2016 | Brogdon et al. | |
| 2016/0096892 A1 | 4/2016 | Brogdon et al. | |
| 2016/0130355 A1 | 5/2016 | June et al. | |
| 2016/0159907 A1 | 6/2016 | June et al. | |
| 2016/0185861 A1 | 6/2016 | Bedoya et al. | |
| 2016/0194404 A1 | 7/2016 | June et al. | |
| 2016/0208012 A1 | 7/2016 | June et al. | |
| 2016/0311907 A1 | 10/2016 | Brogdon et al. | |
| 2016/0311917 A1 | 10/2016 | Beatty et al. | |
| 2016/0340406 A1 | 11/2016 | Zhao et al. | |
| 2017/0008963 A1 | 1/2017 | Brogdon et al. | |
| 2017/0081411 A1 | 3/2017 | Engels et al. | |
| 2017/0137783 A1 | 5/2017 | Bedoya et al. | |
| 2017/0183415 A1 | 6/2017 | Brogdon et al. | |
| 2017/0209492 A1 | 7/2017 | June et al. | |
| 2017/0211055 A1 | 7/2017 | Brogdon et al. | |
| 2017/0226495 A1 | 8/2017 | Guimaraes | |
| 2017/0239294 A1 | 8/2017 | Thomas-Tikhonenko et al. | |
| 2017/0260268 A1 | 9/2017 | Beatty et al. | |
| 2017/0274014 A1 | 9/2017 | Brogdon et al. | |
| 2017/0306416 A1 | 10/2017 | Bedoya et al. | |
| 2017/0335281 A1 | 11/2017 | Loew et al. | |
| 2018/0022795 A1 | 1/2018 | Milone et al. | |
| 2018/0044423 A1 | 2/2018 | Ebersbach et al. | |
| 2018/0044424 A1 * | 2/2018 | June | C07K 16/2863 |
| 2018/0118834 A1 | 5/2018 | Brogdon et al. | |
| 2018/0125892 A1 | 5/2018 | Brannetti et al. | |
| 2018/0133296 A1 | 5/2018 | Barrett et al. | |
| 2018/0140602 A1 | 5/2018 | Angst et al. | |
| 2018/0230193 A1 | 8/2018 | Loew et al. | |

FOREIGN PATENT DOCUMENTS

| | | |
|---|---|---|
| EP | 0871495 A1 | 10/1998 |
| EP | 1226244 A2 | 7/2002 |
| JP | 2003517301 A | 5/2003 |
| JP | 2004529636 A | 9/2004 |
| WO | 1992015322 A1 | 9/1992 |
| WO | 9507984 A1 | 3/1995 |
| WO | 199530014 A1 | 11/1995 |
| WO | 9623814 A1 | 8/1996 |
| WO | 9624671 A1 | 8/1996 |
| WO | 1997015669 A1 | 5/1997 |
| WO | 9723613 A2 | 7/1997 |
| WO | 9818809 A1 | 5/1998 |
| WO | 9900494 A2 | 1/1999 |
| WO | 9921581 A1 | 5/1999 |
| WO | 9957268 A1 | 11/1999 |
| WO | 0014257 A1 | 3/2000 |
| WO | 200134843 A1 | 5/2001 |
| WO | 2002033101 A1 | 4/2002 |
| WO | 02077029 A2 | 10/2002 |
| WO | 02088334 A1 | 11/2002 |
| WO | 2003057171 A2 | 7/2003 |
| WO | 2004/003019 A2 | 1/2004 |
| WO | 2005019429 A2 | 3/2005 |
| WO | 2005044996 A2 | 5/2005 |
| WO | 2005/118788 A2 | 12/2005 |
| WO | 2006060878 A1 | 6/2006 |
| WO | 2008045437 A2 | 4/2008 |
| WO | 2008049928 A1 | 5/2008 |
| WO | 2009091826 A2 | 7/2009 |

(56) References Cited

FOREIGN PATENT DOCUMENTS

| | | | |
|---|---|---|---|
| WO | 2010019570 A2 | 2/2010 | |
| WO | 2010025177 A1 | 3/2010 | |
| WO | 2010085660 A2 | 7/2010 | |
| WO | 2010095031 A2 | 8/2010 | |
| WO | 2011059836 A2 | 5/2011 | |
| WO | 2011097477 A1 | 8/2011 | |
| WO | 2012058460 A2 | 5/2012 | |
| WO | 2012079000 A1 | 6/2012 | |
| WO | 2012082841 A2 | 6/2012 | |
| WO | 2012/099973 A2 | 7/2012 | |
| WO | 2012127464 A2 | 9/2012 | |
| WO | 2012129514 A1 | 9/2012 | |
| WO | 2012135854 A2 | 10/2012 | |
| WO | 2012138858 A1 | 10/2012 | |
| WO | 2013019615 A2 | 2/2013 | |
| WO | 2013033626 A2 | 3/2013 | |
| WO | 2013040371 A2 | 3/2013 | |
| WO | 2013040557 A2 | 3/2013 | |
| WO | 2013059593 A1 | 4/2013 | |
| WO | 2013/126712 A1 | 8/2013 | |
| WO | 2013123061 A1 | 8/2013 | |
| WO | 2013126729 A1 | 8/2013 | |
| WO | 2013126733 A1 | 8/2013 | |
| WO | 2014/011984 A1 | 1/2014 | |
| WO | 2014/011987 A1 | 1/2014 | |
| WO | 2014/011993 A2 | 1/2014 | |
| WO | 2014/012001 A2 | 1/2014 | |
| WO | 2014011988 A2 | 1/2014 | |
| WO | 2014011996 A1 | 1/2014 | |
| WO | 2014031687 A1 | 2/2014 | |
| WO | 2014039513 A2 | 3/2014 | |
| WO | 2014/055442 A2 | 4/2014 | |
| WO | 2014055657 A1 | 4/2014 | |
| WO | 2014130635 A1 | 8/2014 | |
| WO | 2014/145252 A2 | 9/2014 | |
| WO | 2014153270 A1 | 9/2014 | |
| WO | 2015075468 A1 | 5/2015 | |
| WO | 2015079417 A1 | 6/2015 | |
| WO | 2015090229 A1 | 6/2015 | |
| WO | 2015090230 A1 | 6/2015 | |
| WO | 2015112626 A1 | 7/2015 | |
| WO | 2015/142661 A1 | 9/2015 | |
| WO | 2015142675 A2 | 9/2015 | |
| WO | 2015157252 A1 | 10/2015 | |
| WO | 2016014501 A1 | 1/2016 | |
| WO | 2016014530 A1 | 1/2016 | |
| WO | 2016014535 A1 | 1/2016 | |
| WO | 2016014553 A1 | 1/2016 | |
| WO | 2016014565 A2 | 1/2016 | |
| WO | 2016014576 A1 | 1/2016 | |
| WO | 2016019300 A1 | 2/2016 | |
| WO | 2016025880 A1 | 2/2016 | |
| WO | 2016028896 A1 | 2/2016 | |
| WO | 2016044605 A1 | 3/2016 | |
| WO | 2016061368 A1 | 4/2016 | |
| WO | 2016100232 A1 | 6/2016 | |
| WO | 2016102965 A1 | 6/2016 | |
| WO | WO-2016149578 A1 * | 9/2016 | ......... C07K 14/7051 |
| WO | 2016/164580 A1 | 10/2016 | |
| WO | 2016164731 A2 | 10/2016 | |

OTHER PUBLICATIONS

Rudikoff et al. (PNAS USA, 1982, 79: 1979-1983) (Year: 1982).*
Coleman et al. (Research in Immunology, 1994; 145(1): 33-36) (Year: 1994).*
Abaza et al. (Journal of Protein Chemistry, vol. 11, No. 5, 1992, pp. 433-444) (Year: 1992).*
Haso et al. (Blood Oct. 21, 2013) 122 (21): Abstract No. 1431) (Year: 2013).*
"EP Vantage—ASH—Novartis, 3-35 Juno, June and Rosenberg steal the T-cell show" EP Vantage (2014) Retrieved from the Internet: http://epvantage.com/universal/view.aspx?type=story&id=546429&isEPVantage=yes; Retrived on Jul. 25, 2016.
"Pilot study for Patients with chemotherapy resistant or refractory CD19 Leukemia and Lymphoma (CART-19)" ClinicalTrials.gov Identifier NCT00891215; Retrieved from the internet on Sep. 2, 2015 Found at http://web.archive.org/web/20090903002304/http://clinicaltrials.gov/ct2/show/study/NCT00891215.
A NCBI Direct Submission NP 000725 dated Nov. 21, 2010.
A NCBI Direct Submission NP 932170.1 dated Nov. 21, 2010.
Accession No. NM_001178098, dated Mar. 15, 2015.
Advani et al., "Bruton tyrosine kinase inhibitor ibrutinib (PCI-32765) has significant activity in patients with relapsed/refractory B-cell malignancies." Journal of Clinical Oncology (2012) vol. 31 No. 1 pp. 88-94.
Advani et al., "Bruton tyrosine kinase inhibitor ibrutinib (PCI-32765) has significant activity in patients with relapsed/refractory B-cell malignancies." Journal of Clinical Oncology (2013) vol. 31 No. 1 pp. 88-94.
Agata et al. "Expression of the PD-1 antigen on the surface of stimulated mouse T and B lymphocytes", International Immunology (1996) vol. 8 No. 5 pp. 765-772.
AppliChem product sheet for RPMI-1640, 2 pages, downloaded Dec. 28, 2015.
Awan and Byrd, "New Strategies in Chronic Lymphocytic Leukemia: Shifting Treatment Paradigms" Clinical Cancer Research (2014) vol. 20 No. 23 pp. 5869-5874.
Baeksgaard & Sorensen, "Acute tumor lysis syndrome in solid tumors—a case report and review of the literature" Cancer Chemotherapy Pharmacology (2003) vol. 51 pp. 187-192.
Batzer et al. "Enhanced evolutionary PCR using oligonucleotides with inosine at the 3'-terminus" (1991) vol. 19, No. 18, pp. 5081.
Bierer et al., "Cyclosporin A and FK506: molecular mechanisms of immunosuppression and probes for transplantation biology" Current Opinion in Immunology (1992) vol. 5 pp. 763-773.
Blank et al. "Interaction of PD-L1 on tumor cells with PD-1 on tumor-specific T cells as a mechanism of immune evasion: implications for tumor immunotherapy." Cancer Immunol Immunother (2005) vol. 54 No. 4 pp. 307-314.
Bondanza et al. "Suicide gene therapy of graft-versus-host disease induced by central memory human T lymphocytes" Blood (2006) vol. 107 No. 5 pp. 1828-1836.
Brentjens et al. "Genetically Targeted T Cells Eradicate Systemic Acute Lymphoblastic Leukemia Xenografts", Clinical Cancer Research(2007) vol. 13, No. 18, pp. 5426-5435.
Brentjens et al. "Novel cellular therapies for leukemia: CAR-modified T cells targeted to the CD19 antigen" Hematology (2012) pp. 143-151.
Brentjens et al. "Treatment of Chronic Lymphocytic Leukemia With Genetically Targeted Autologous T Cells: Case Report of an Unforeseen Adverse Event in a Phase I Clinical Trial" The American Society of Gene Therapy (2010) vol. 18 No. 4 pp. 666-668.
Brentjens et al., "A Phase I Trial for the Treatment of chemo-Refractory Chronic Lymphocytic Leukemia with CD19-Targeted Autologous T Cells" Molecular Therapy (2008) vol. 16 Suppl 1 p. S15.
Brentjens et al., "CD19-Targeted T Cells Rapidly Induce Molecular Remissions in Adults with Chemotherapy-Refractory Acute Lymphoblastic Leukemia," Sci. Transl. Med. 5:177ra138 (2013).
Brentjens et al., "Eradication of systemic B-cell tumors by genetically targeted human T lymphocytes co-stimulated by CD80 and interleukin-15" Nature Medicine (2003) vol. 9 No. 3 pp. 279-286.
Brentjens et al., "Safety and persistence of adoptively transferred autologous CD19-targeted T cells in patients with relapsed or chemotherapy refractory B-cell leukemias" Blood (2011) vol. 118 No. 18 pp. 4817-4828.
Brocker and Karjalainen, "Signals through T Cell Receptor-Chain alone Are Insufficient to Prime Resting T Lymphocytes" J. Exp. Med. (1995) vol. 181 pp. 1653-1659.
Brown J R et al: "Novel Treatments for Chronic Lymphocytic Leukemia and Moving Forward",American Society of Clinical Oncology Educational Book,vol. 34, 2014, pp. e317-e325,XP05520 1368,ISSN: 1548-8748, DOI:10.14694/EdBook_AM.2014..34. e317 the whole document.

(56) References Cited

OTHER PUBLICATIONS

Byrd et al., "Targeting BTK with ibrutinib in relapsed chronic lymphocytic leukemia." New England Journal of Medicine (2013) vol. 369 No. 1 pp. 32-42.
Call & Wucherpfennig, "The T Cell Receptor: Critical Role of the Membrane Environment in Receptor Assembly and Function" Annu. Rev. Immunol. (2005) vol. 23 pp. 101-125.
Campana et al., 2003 Blood 102(11); abstract #223.
Carpenito et al. "Control of large, established tumor xenografts with genetically retargeted human T cells containing CD28 and CD137 domains", Proc Natl Acad Sci USA (2009) vol. 106 pp. 3360-3365.
Carter et al. "PD-1:PD-L inhibitory pathway affects both CD4+ and CD8+ T cells and is overcome by IL-2" Eur. J. Immunol. (2002) vol. 32 pp. 634-643.
Casulo et al., "A phase I study of PRO131921, a novel anti-CD20 monoclonal antibody in patients with relapsed/refractory CD20+ indolent NHL: correlation between clinical responses and AUC pharmacokinetics." Clinical Immunology (2014) vol. 154 No. 1 pp. 37-46.
Cheson et al., "Report of an International Workshop to Standardize Response Criteria for Non-Hodgkin's Lynphomas" Journal of Clinical Oncology (1999) vol. 17 pp. 1244-1253.
Chothia et al. "Canonical structures for the hypervariable regions of immunoglobulins" Journal of Molecular Biology (1987) vol. 196, No. 4, pp. 901-917.
Colman et al. "Effects of amino acid sequence changes on antibody-antigen interactions" Research in Immunology (1994) vol. 145, pp. 33-36.
Cooper et al. "Test-driving CARs" Blood (2008) vol. 112, No. 5, pp. 2172-2173.
Cruz et al. "Adverse events following infusion of T cells for adoptive immunotherapy: a 10-year experience" Cytotherapy (2010) vol. 12, No. 6, pp. 743-749.
Davila et al, "T Cells Genetically Targeted to CD19 Eradicate B-All in a Novel Syngeneic Mouse Disease Model" 2010 ASH Abstract No. 171, presented Dec. 6, 2010 (poster abstract).
Davila et al. "B Cell Aplasia in a Patient with Relapsed B Cell Acute Lymphoblastic Leukemia Following Re-Induction and Consolidation with Autologous T Cells Genetically Targeted to the CD19 Antigen" 53rd ASH Annual Meeting and Exposition (2010) Oral and Poster Abstract.
De Visser et al., "De novo carcinogenesis promoted by chronic inflammation is B lymphocyte dependent." Cancer cell (2005) vol. 7 No. 5 pp. 411-423.
Di Stasi et al., "Inducing apoptosis as a safety switch for adoptive cell therapy" New England Journal of Medicine (2011) vol. 365 No. 18 pp. 1673-1683.
Dohner et al., "p53 Gene Deletion Predicts for Poor Survival and Non-Response to Therapy With Purine Analogs in Chronic B-Cell Leukemias" Blood (1995) vol. 85 No. 6 pp. 1580-1589.
Dong et al. "B7-H1 pathway and its role in the evasion of tumor immunity." J Mol Med (2003) vol. 81 No. 5 pp. 281-287.
Dropulic and June, "Gene-Based Immunotherapy for Human Immunodeficiency Virus Infection and Acquired Immunodeficiency Syndrome" Human Gene Therapy (2006) vol. 17 pp. 577-588.
Dubovsky et al., "Ibrutinib is an irreversible molecular inhibitor of ITK driving a Th1-selective pressure in T lymphocytes." Blood (2013) vol. 122 No. 15 pp. 2539-2549.
Dudley et al. "Malignancy Persisting After Allogeneic Hematopoietic Stem Cell Transplantation" Blood (2013) vol. 122, No. 21, pp. 151—Abstract Only.
Dull et al, "A Third-Generation Lentivirus Vector with a Conditional Packaging System" Journal of Virology (1998) vol. 72 No. 11 pp. 8463-8471.
Durie et al. "International uniform response criteria for multiple myeloma" Leukemia (2006) vol. 20, No. 9, pp. 1467-1473.
Eshhar et al., "Specific activation and targeting of cytotoxic lymphocytes through chimeric single chains consisting of antibody-binding domains and the gamma or zeta subunits of the immunoglobulin and T-cell receptors," PNAS USA 90: 720-724 (1993).

Evans et al., "Evolution to Plasmablastic Lymphoma (PBL) after CAR-T Cell Therapy in a Case of SLL/CLL with Richter's Transformation" Blood (2014) vol. 124 No. 21.
FDA: Highlights of Prescribing Information for Arzerra (2009).
FDA: Highlights of Prescribing Information for Gazyva (2013).
Nicholson et al., "Construction and Characterisation of a Function CD19 Specific Single Chain Fv Fragment for Immunotherapy of B Lineage Leukaemia and Lymphoma," Molecular Immunology 34(I6-I7): 1157-1165 (1997).
Ochoa et al, "Immune Defects in T Cells from Cancer Patients, Parallels in Infectious Diseases" Cancer Immunotherapy at the Crossroads: how tumors evade immunity and what can be done (current clinical oncology), edited by James H. Finke, Ronald M. Bukowski, 2004 edition.
Ohtsuka et al. "An Alternative Approach to Deoxyoligonucleotides as Hybridization Probes by Insertion of Deoxyinosine at Ambiguous Codon Positions" The Journal of Biological Chemistry (1985) vol. 260, No. 5, pp. 2605-2608.
Pardoll, "The blockade of immune checkpoints in cancer immunotherapy" Cancer (2012) vol. 12 pp. 252-264.
Parikh et al., "How we treat Richter syndrome." Blood (2014) vol. 123 No. 11 pp. 1647-1657.
Park and Brentjens "Adoptive Immunotherapy for B-cell Malignancies with Autologous Chimeric Antigen Receptor Modified Tumor Targeted T Cells" Discovery Medicine (2010) vol. 9 No. 47 pp. 277-288.
Park et al. "Adoptive Transfer of Chimeric Antigen Receptor Re-directed Cytolytic T Lymphocyte Clones in Patients with Neuroblastoma", Molecular Therapy (2007) vol. 15 No. 4 pp. 825-833.
Patel et al., "Impact of chimeric immune receptor extracellular protein domains on T cell function" Gene Therapy (1999) vol. 6 pp. 412-419.
Ponader et al., "The Bruton tyrosine kinase inhibitor PCI-32765 thwarts chronic lymphocytic leukemia cell survival and tissue homing in vitro and in vivo" Blood (2012) vol. 119 No. 5 pp. 1182-1189.
Porter et al. "Chimeric Antigen Receptor-Modified T Cells in Chronic Lymphoid Leukemia", The New England Journal of Medicine (2011) vol. 365 No. 8 pp. 725-733.
Porter et al., "A phase 1 trial of donor lumphocyte infusions expanded and activated ex vivo via CD3/CD28 costimulation" Blood (2006) vol. 107 No. 4 pp. 1325-1331.
Porter et al., "Chimeric antigen receptor T cells persist and induce sustained remissions in relapsed refractory chronic lymphocytic leukemia" Science Translational Medicine (2015) vol. 7 No. 303 303ra139.
Porter et al., "Chimeric Antigen Receptor Therapy for B-cell Malignancies" Journal of Cancer (2011) vol. 2 pp. 331-332.
Porter et al., "Randomized, Phase II Dose Optimization Study of Chimeric Antigen Receptor Modified T Cells Directed Against CD19 (CTL019) in Patients with Relapsed, Refractory CLL" Blood (2014) vol. 124 No. 21.
Pule et al., "Virus-specific T cells engineered to coexpress tumor-specific receptors: persistence and antitumor activity in individuals with neuroblastoma" Nat. Med. (2008) vol. 14 No. 11 pp. 1264-1270.
Pyonteck et al., "CSF-1R inhibition alters macrophage polarization and blocks glioma progression." Natural Medicine (2013) vol. 19 No. 10 pp. 1264-1272.
Rapoport et al., "Restoration of immunity in lymphopenic individuals with cancer by vaccination and adoptive T-cell transfer" Nature Medicine (2005) vol. 11 No. 11 pp. 1230-1237.
Robak & Robak, "New Anti-CD20 Monoclonal Antibodies for the Treatment of B-Cell Lymphoid Malignancies" Biodrugs (2011) vol. 25 No. 1 pp. 13-25.
Roederer, "T-cell dynamics of immunodeficiency" Nature Medicine (1995) vol. 1 No. 7 pp. 621-622.
Romeo et al., "Cellular immunity to HIV activated by CD4 fused to T cell or Fc receptor polypeptides," Cell 64:1037-1046 (1991).
Romisher et al., "Bruton's Tyrosine Kinase Inhibition Is Associated with Manageable Cardiac Toxicity" Blood (2015) vol. 126 No. 23.

(56) References Cited

OTHER PUBLICATIONS

Rossolini et al. "Use of deoxyinosine-containing primers vs degenerate primers for polymerase chain reaction based on ambiguous sequence information" Molecular and Cellular Probes (1994) vol. 8, No. 2, pp. 91-98.
Rudikoff et al. "Single amino acid substitutuion altering antigen-binding specificity" Proc. Natl. Acad. Sci. (1982) vol. 79, pp. 1979-1983.
Ruella and Gill, "How to train your T cell: genetically engineered chimeric antigen receptor T cells versus bispecific T-cell engagers to target CD19 in B acute lymphoblastic leukemia." (2015) vol. 15 No. 6 pp. 761-766.
Ruella et al. "Novel Chimeric Antigen 3-35 Receptor T Cells for the Treatment of CD19-Negative Relapses Occurring after CD19-Targeted Irrenunotherapies" Blood (2014) vol. 124, p. 966.
Ruella et al., "Combination of Ibrutinib and Anti-CD19 Chimeric Antigen Receptor T Cells for the Treatment of Relapsing/Refractory Mantle Cell Lymphoma (MCL)" Haematologica (2015) vol. 100 pp. 287-288.
Ruella et al., "The Addition of the BTK Ibrutinib to Anti-CD19 Chimeric Antigen Receptor T Cells (CART19) Improves Responses against Mantle Cell Lymphoma" Clinical Cancer Research (2016) 1-13.
Sabbagh et al., "TNF family ligands define niches for T cell memory" Trends in Immunology (2007) vol. 28 No. 8 pp. 333-339.
Sadelain et al. "The promise and potential pitfalls of chimeric antigen receptors." Current Opinion Immunology (2009) vol. 21 No. 2 pp. 215-223.
Sadelain et al., "Targeting Tumours with Genetically Enhanced T Lymphocytes," Nature Reviews: Cancer 3: 35-45 (2003).
Sagiv-Barfi, et al., "Ibrutinib enhances the antitumor immune response induced by intratumoral injection of a TLR9 ligand in mouse lymphoma" Blood, 125(13):2079-2086 (2015).
Sagiv-Barfi, et al., "Therapeutic antitumor immunity by checkpoint blockade is enhanced by ibrutinib, an inhibitor of both BTK and ITK" PNAS, 112(9):E966-E972 (2015).
Salvadori, "Antineoplastic effects of mammalian target of rapamycine inhibitors." World Journal of Transplantation (2012) vol. 2 No. 5 pp. 74-83.
Santoni et al., "Role of natural and adaptive immunity in renal cell carcinoma response to VEGFR-TKIs and mTOR Inhibitor" International Journal of Cancer (2014) vol. 134 No. 12 pp. 2772-2777.
Savoldo et al., "CD28 costimulation improves expansion and persistence of chimeric antigen receptor-modified T cells in lymphoma patients" The Journal of Clinical Investigation (2011) vol. 121 No. 5 pp. 1822-1826.
Scott et al., "Monoclonal antibodies in cancer therapy" Cancer Immunity (2012) vol. 12 p. 14.
Sebestyen et al., "Human TCR That Incorporate CD3 Induce Highly Preferred Pairing between TCR and Chains following Gene Transfer" Journal of Immunology (2008) vol. 180 pp. 7736-7746.
Shi et al. "Chimeric antigen receptor for adoptive immunotherapy of cancer: latest research and future prospects" Molecular Cancer (2014) vol. 13, No. 219, pp. 1-8.
Shirasu et al. "Functional Design of Chimeric T-Cell Antigen Receptors for Adoptive Immunotherapy of Cancer: Architecture and Outcomes" Anticancer Research (2012) vol. 32, pp. 2377-2384.
Shirasu et al., "Functional Design of Chimeric T-Cell Antigen Receptors for Adoptive Immunotherapy of Cancer: Architecture and Outcomes," AntiCancer Res. 32: 2377-2384 (2012).
Sidaway, "Ibrutinib supercharges CAR T cells" Nature Reviews Clinical Oncology (2016) Abstract.
Smith-Gill et al., "Contributions of Immunoglobulin Heavy and Light Chains to Antibody Specificity for Lysozyme and Two Haptens" The Journal of Immunology (1987) vol. 139, pp. 4135-4144.
Song et al. "CD27 costimulation augments the survival and antitumor activity of redirected human T cells in vivo" Blood (2012) vol. 119, No. 3, pp. 696-706.

Song et al. "Light Chain of Natural Antibody Plays a Dominant Role in Protein Antigen Binding" Biochemical and Biophysical Research Communications (2000) vol. 268, pp. 390-394.
Sorror et al., "Outcomes after allogeneic hematopoietic cell transplantation with nonmyeloablative or myeloablative conditioning regimens for treatment of lymphoma and chronic lymphocytic leukemia" Blood (2008) vol. 111 No. 1 pp. 446-452.
Tammana Syam et al., "4-1BB and CD28 Signaling plays a synergistic role in redirecting umbibical cord blood T cells against B-cell malignancies" Human Gene Therapy (2010) vol. 21, pp. 75-86.
Till et al., "Adoptive immunotherapy for indolent non-Hodgkin lymphoma and mantle cell lymphoma using genetically modified autologous CD20-specific T cells" Blood (2008) vol. 112 No. 6 pp. 2261-2271.
Trinh et al. "Optimization of codon pair use within the (GGGGS)3 linker sequence results in enhanced protein expression" Molecular Immunology (2004) vol. 40, pp. 717-722.
Uckun et al., "Detailed studies on expression and function of CD19 surface determinant by using B43 monoclonal antibody and the clinical potential of anti-CD19 immunotoxins" Blood (1988) vol. 71 pp. 13-29.
UniProt/Swiss-Prot Accession No. P15391, Apr. 1, 1990.
FDA: Highlights of Prescribing Information for Rituxan (2010).
Finn et al., "Current and Future Treatment Strategies for Patients with Advanced Hepatocellular Carcinoma: Role of mTOR Inhibition." Liver Cancer (2012) vol. 1 No. 3-4 pp. 247-256.
Finney et al., "Activation of resting human primary T cells with chimeric receptors: costimulation from CD28, inducible costimulator, CD134, and CD137 (4-1BB) in series with signals from the TCR zeta chain," J. Immunol. 172: 104-113 (2004).
Finney et al., "Chimeric receptors providing both primary and costimulatory signaling in T cells from a single gene product," J. Immunol. 161: 2791-2797 (1998).
Forero-Torres et al., "Results of a phase 1 study of AME-133v (LY2469298), an Fc-engineered humanized monoclonal anti-CD20 antibody, in Fc?RIIIa-genotyped patients with previously treated follicular lymphoma." Clinical Cancer Research (2012) vol. 18 No. 5 pp. 1395-1403.
Fraietta et al., "Ibrutinib enhances chimeric antigen receptor T-cell engraftment and efficacy in leukemia" Blood (2016) vol. 127 No. 9 pp. 1117-1127.
Fraietta et al., "P.D.14.19—Longitudinal Effects of Ibrutinib Therapy on T Lymphocytes: Implications for Combination Adoptive Cell Strategies to Treat Chronic Lymphocytic Leukemia (CLL)" The 4th European Congress of Immunology (2015) Presentation Abstract.
Freeman et al "Engagement of the PD-1 Immunoinhibitory Receptor by a Novel B7 Family Member Leads to Negative Regulation of Lymphocyte Activation", Journal of Exp Med (2000) vol. 192 No. 7 pp. 1027-1034.
Frey, N. "Genetically Engineered Lymphocyte Therapy in Treating Patients With B-Cell Leukemia or Lymphoma That is Resistant or Refractory to Chemotherapy" (2015) Clinical Trial NCT01029366.
Friedmann-Morvinski et al., "Redirected primary T cells harboring a chimeric receptor require costimulation for their antigen-specific activation," Blood 105: 3087-3093 (2005).
Geiger & Jyothi, "Development and Application of Receptor-Modified T Lymphocytes for Adoptive Immunotherapy" Transfusion Medicine Reviews (2001) vol. 15 No. 1 pp. 21-34.
Geiger et al., "Integrated src kinase and costimulatory activity enhances signal transduction through single-chain chimeric receptors in T lymphocytes," Blood 98(8): 2364-2371 (2001).
GenBank Acc. No. AAA62478.2 (41bb), Mar. 5, 1999.
GenBank Acc. No. BAG36664.1 (zeta), May 24, 2008.
GenBank Accession No. NP_000725.1 accessed on Jan. 7, 2016 from http://www.ncbi.nlm.nih.gov/protein/NP_000725.
GenBank Accession No. NP_932170.1 accessed Jan. 7, 2016 from http://www.ncbi.nlm.nih.gov/protein/NP_932170.
Gilham et al., "Primary Polyclonal Human T Lymphocytes Targeted to Carcino-Embryonic Antigens and Neural Cell Adhesion Molecule Tumor Antigens by CD3-Based Chimeric Immune Receptors" Journal of Immunotherapy (2002) vol. 25 No. 2 pp. 139-151.

(56) References Cited

OTHER PUBLICATIONS

Goldenberg et al., "Veltuzuman (humanized anti-CD20 monoclonal antibody): characterization, current clinical results, and future prospects" Leukemia & Lymphoma (2010) vol. 51 No. 5 pp. 747-755.
Gong et al. "Cancer Patient T Cells Genetically Targeted to Prostate-Specific Membrane Antigen Specifically Lyse Prostate Cancer Cells and Release Cytokines in Response to Prostate-Specific Membrane Antigen" Neoplasia (1999) vol. 1 No. 2 pp. 123-127.
Gribben et al., "Stem cell transplantation for indolent lymphoma and chronic lymphocytic leukemia" Biol Blood Marrow Transplant (2011) vol. 17 (1 Suppl): S63-S70.
Griffin, "Development and applications of surface-linked single chain antibodies against T-cell antigens" Journal of Immunological Methods (2001) vol. 248 pp. 77-90.
Gross et al., "Endowing T cells with antibody specificity using chimeric T cell receptors," The FASEB Journal 6: 3370-3378 (1992).
Grupp et al. "Chimeric Antigen Receptor-Modified T Cells for Acute Lymphoid Leukemia", New England Journal of Medicine (2013) vol. 368 No. 16 pp. 1509-1518.
Hallek et al., "Guidelines for the diagnosis and treatment of chronic lymphocytic leukemia: a report from the International Workshop on Chronic Lymphocytic Leukemia updating the National Cancer Institute Working Group 1996 guidelines" Blood (2008) vol. 111 No. 12 pp. 5446-5456.
Haso et al. "Anti-CD22-chimeric antigen receptors targeting B cell precursor acute lymphoblastic leukemia" Blood (2012) ; doi:10.1182/blood-2012-06-438002.
Hekele et al., "Growth Retardation of Tumors by Adoptive Transfer of Cytotoxic T Lymphocytes Reprogrammed by CD44V6-Specific SCFV:~-Chimera" Int J. Cancer (1996) vol. 68 pp. 232-238.
Henderson et al., "Comparison of the effects of FK-506, cyclosporin A and rapamycin on IL-2 production." Immunology (1991) No. 73 vol. 3 pp. 316-321.
Ho et al., "Adoptive immunotherapy: Engineering T cell responses as biological weapons for tumor mass destruction" Cancer Cell (2003) vol. 3 pp. 431-437.
Hollyman et al. "Manufacturing validation of biologically functional T cells targeted to CD19 antigen for autologous adoptive cell therapy" J Immunother (2009) vol. 32 No. 2 pp. 169-180.
Hombach et al. "OX40 costimulation by a chimeric antigen receptor abrogates CD28 and IL-2 induced IL-10 secretion by redirected CD4+ T cells" OncoImmunology (2012) vol. 1, No. 4, pp. 458-466.
Homback et al., "The Recombinant T Cell Receptor Strategy: Insights into Structure and Function of Recombinant Immunoreceptors on the Way Towards an Optimal Receptor Design for Cellular Immunotherapy," Current Gene Therapy 2: 211-226 (2002).
Honigberg et al., "The Bruton tyrosine kinase inhibitor PCI-32765 blocks B-cell activation and is efficacious in models of autoimmune disease and B-cell malignancy." Proc Natl Acad Sci (2010) vol. 107 No. 29 pp. 13075-13080.
Hutchinson et al. "Breaking good: the inexorable rise of BTK inhibitors in the treatment of chronic lymphocytic leukaemia" British Journal of Haematology (2014) vol. 166, pp. 12-22.
Huye E L et al: 'Combining mTor Inhibitors With Rapamycin-resistant T Cells: A Two-pronged Approach to Tumor Elimination',Molecular Therapy,vol. 19, No. 12,Aug. 30, 2011 (Aug. 30, 2011), pp. 2239-2248, XP055191016, GB, ISSN: 1525-0016, DOI: 10.1038/mt.2011.179 the whole document.
Imai et al., "Chimeric receptors with 4-1BB signaling capacity provoke potent cytotoxicity against acute lymphoblastic leukemia," Leukemia 18: 676-684 (2004).
Imai et al., "Genetic modification of primary natural killer cells overcomes inhibitory signals and induces specific killing of leukemic cells" Blood (2005) vol. 106 No. 1 pp. 376-383.
International Preliminary Report on Patentability for International Application No. PCT/US2014/029943 dated Sep. 22, 2015.
International Search Report and Written Opinion for International Application No. PCT/US2014/029943 dated Jul. 17, 2014.
International Search Report and Written Opinion for International application No. PCT/US2015/024671, dated Jul. 31, 2015.
International Search Report and Written Opinion for International Application No. PCT/US2016/026437 dated Jun. 29, 2016.
International Search Report and Written Opinion for International Application No. PCT/US2016/026655 dated May 10, 2016.
International Search Report from PCT/US2011/064191 dated Jan. 5, 2012.
Intlekofer et al. "At the Bench: Preclinical rationale for CTLA-4 and PD-1 blockade as cancer immunotherapy" J Leukoc Biol (2013) vol. 94, No. 1, pp. 25-39.
Irving et al., "The cytoplasmic domain of the T cell receptor zeta chain is sufficient to couple to receptor-associated signal transduction pathways," Cell 64: 891-901 (1991).
Jena, Bipulendu et al. "Redirecting T-cell specificity by introducing a tumor-specific chimeric antigen receptor, Blood, May 3, 2010", vol. 116, No. 7, pp. 1035-1044.
Jensen et al., "Anti-Transgene Rejection Responses Contribute to Attenuated Persistence of Adoptively Transferred CD20/CD19-Specific Chimeric Antigen Receptor Re-directed T Cells in Humans" Biol Blood Marrow Transplant (2010) vol. 16 No. 9 pp. 1245-1256.
Johnson et al., "Gene therapy with human and mouse T-cell receptors mediates cancer regression and targets normal tissues expressing cognate antigen" Blood (2009) vol. 114 No. 3 pp. 535-545.
Jones et al., "Circulating clonotypic B cells in classic Hodgkin lymphoma." Blood (2009) vol. 113 No. 23 pp. 5920-5926.
Joo et al., "Targeted cancer therapy—are the days of systemic chemotherapy numbered?" Maturitas (2013) vol. 76 No. 4 pp. 308-314.
June et al., "Engineering lymphocyte subsets: tools, trials and tribulations" Nat Rev Immunol (2009) vol. 9 No. 10 pp. 704-716.
Vajdos et al. "Comprehensive Functional Maps of the Antigen-binding Site of an Anti-ErbB2 Antibody Obtained with Shotgun Scanning Mutagenesis" Journal of Molecular Biology (2002) vol. 320, pp. 415-428.
Vinay & Kwon, "Role of 4-1BB in immune responses" Immunology (1998) vol. 10 pp. 481-489.
Wang et al. "Vista, a novel mouse Ig superfamily ligand that negatively regulates T cell responses" The Journal of Experimental Medicine (2011) vol. 208, No. 3, 577-592.
Wang et al., "Targeting BTK with ibrutinib in relapsed or refractory mantle-cell lymphoma." New England Journal of Medicine (2013) vol. 369 No. 6 pp. 507-516.
Wang et al., "Utilization of Next Generation Sequencing Identifies Potentially Actionable Mutations with Prognostic Significance in Chronic Lymphocytic Leukemia" Blood (2015) vol. 126 No. 23.
Ward et al. "Binding activities of a repertoire of single immunoglobulin variable domains secreted from *Escherichia coli*" Nature (1989) vol. 341, pp. 544-546.
Willemsen et al., "Genetic Engineering of T Cell Specificity for Immunotherapy of Cancer" Human Immunology (2003) vol. 64 pp. 56-68.
Woyach et al., "Resistance mechanisms for the Bruton's tyrosine kinase inhibitor ibrutinib." New England Journal of Medicine (2014) vol. 370 No. 24 pp. 2286-2294.
Xu et al. "γc Cytokines IL7 and IL15 Expanded Chimeric Antigen Receptor-Redirected T Cells (CAR-T) with Superior Antitumor Activity In Vivo" Molecular Therapy (2013) vol. 21, pp. S20-S21.
Xu V et al: "Closely related T-memory stem cells correlate with in vivo expansion of CAR.CD19-T cells and are preserved by IL-7 and IL-15", Blood, vol. 123, No. 24, Apr. 29, 2014 (Apr. 29, 2014), pp. 3750-3759, XP055201372, ISSN: 0006-4971, DOI:10.1182/blood-2014-01-552174.
Younes et al., "Phase 2 study of rituximab plus ABVD in patients with newly diagnosed classical Hodgkin lymphoma." Blood (2012) vol. 119 No. 18 pp. 4123-4128.
Zah et al. "T cells expressing CD19/CD20 bi-specific chimeric antigen receptors prevent antigen escape by malignant B cells" Cancer Immunology Research (2016) vol. 4, No. 6, pp. 498-508.
Zhao et al., "A Herceptin-Based Chimeric Antigen Receptor with Modified Signaling Domains Leads to Enhanced Survival of Transduced T Lymphocytes and Antitumor Activity" The Journal of Immunology (2009) vol. 183 pp. 5563-5574.

(56) References Cited

OTHER PUBLICATIONS

Zufferey et al., "Multiply attenuated lentiviral vector achieves efficient gene delivery in vivo" Nature Biotechnology (1997) vol. 15 pp. 871-876.
June, "Adoptive T cell therapy for cancer in the clinic" Journal of Clinical Investigation (2007) vol. 117 No. 6 pp. 1466-1476.
Kalos et al. "T Cells with Chimeric Antigen Receptors Have Potent Antitumor Effects and Can Establish Memory in Patients with Advanced Leukemia", Science Translation Medicine (2011) vol. 3 No. 95 95ra73.
Kalos et al.,"T cells with chimeric antigen receptors have potent antitumor effects and can establish memory in patients with advanced leukemia." Science Translational Medicine (2011) vol. 3 No. 95 95ra73.
Kappos et al., "Ocrelizumab in relapsing-remitting multiple sclerosis: a phase 2, randomised, placebo-controlled, multicentre trial." Lancet (2011) vol. 378 No. 9805 pp. 1779-1787.
Karlsson et al. "Combining CAR T cells and the Bcl-2 family apoptosis inhibitor ABT-737 for treating B-cell malignancy" Cancer Gene Therapy (2013) vol. 20, pp. 386-393.
Kershaw et al., "A Phase I Study on Adoptive Immunotherapy Using Gene-Modified T Cells for Ovarian Cancer," Clin. Cancer Res. 12(20 Pt 1): 6106-6115 (2006).
Kim et al. "B-cell Depletion Using an Anti-CD20 Antibody Augments Antitumor Immune Responses and Immunotherapy in Nonhematopoetic Murine Tumor Models" Journal of Immunotherapy (2008) vol. 31 No. 5 pp. 446-457.
Kim et al., "Human 4-1BB regulates CD28 co-stimulation to promote Th1 cell responses" Eur. J. Immunol. (1998) vol. 28 pp. 881-890.
Kochenderfer et al, "A Phase I Clinical Trial of Treatment of B-Cell Malignancies with Autologous Anti-Cd19-CAR-Transduced T Cells" Blood (2010) vol. 116 No. 21 pp. 1179-1180 & 52nd Annual Meeting of the American-Society-Of-Hematology (ASH), Orlando, FL, USA; Dec. 4-7, 2010 abstract.
Kochenderfer et al. "Construction and Pre-clinical Evaluation of an Anti-CD19 Chimeric Antigen Receptor", J Immunother (2009) vol. 32, No. 7, pp. 389-702.
Kochenderfer et al., "Eradication of B-lineage cells and regression of lymphoma in a patient treated with autologous T cells genetically-engineered to recognize CD19," Blood 116: 4099-4102 (2010).
Kochenderfer et al., "Novel Antigen-Specific Expansion of T Cells Transduced with a CD19 Chimeric Antigen Receptor" 2010 ASH Meeting Abstract No. 3262, presented Dec. 6, 2010 (poster abstract).
Kochenderfer, et al. "Adoptive transfer of syngeneic T cells transduced with a chimeric antigen receptor that recognizes murine CD19 can eradicate lymphoma and normal B cells" Blood (2010) vol. 116, No. 9, pp. 3875-3886.
Kofler et al. "CD28 Costimulation Impairs the Efficacy of a Redirected T-cell Antitumor Attack in the Presence of Regulatory T cells Which Can Be Overcome by Preventing Lck Activation" Molecular Therapy (2001) vol. 19, No. 4, 760-767.
Kohn et al. "CARs on Track in the Clinic", Molecular Therapy (2011) vol. 19, No. 3, pp. 432-438.
Konishi et al. "B7-H1 Expression on Non-Small Cell Lung Cancer Cells and Its Relationship with Tumor-Infiltrating Lymphocytes and Their PD-1 Expression" Clinical Cancer Research (2004) vol. 10 pp. 5094-5100.
Kraus et al., "Antigen-dependent CD28 Signaling Selectively Enhances Survival and Proliferation in Genetically Modified Activated Human Primary T Lymphocytes" J. Exp. Med. (1998) vol. 188 Np 4 pp. 619-626.
Kumar et al. "Molecular Cloning and Expression of the Fabs of Human Autoantibodies in *Escherichia coli*" The Journal of Biological Chemistry (2000) vol. 275, No. 45, pp. 35129-35136.
Kwon et al., "cDNA sequences of two inducible T-cell genes". Proc. Natl. Acad. Sci. U.S.A. 86(6): 1963-1967 (1989).
Lamanna et al., "Pentostatin, Cyclophosphamide, and Rutuximab Is an Active, Well-Tolerated Regimen for Patients With Previously Treated Chronic Lymphocytic Leukemia" Journal of Clinical Oncology (2008) vol. 24 No. 10 pp. 1575-1581.
Lamers et al. "Immune responses to transgene and retroviral vector in patients treated with ex vivo-engineered T cells" Blood (2011) vol. 117, No. 1, pp. 72-82.
Lamers et al., "Treatment of Metastatic Renal Cell Carcinoma With Autologous T-Lymphocytes Genetically Retargeted Against Carbonic Anhydrase IX: First Clinical Experience," J. Clin. Oncol. 24(13): e20-e22 (2006).
Laport et al., "Adoptive transfer of costimulated T cells induces lymphocytosis in patients with relapsed/refractory non-Hodgkin lymphoma following CD34 +-selected hematopoietic cell transplantation" Blood (2003) vol. 102 No. 6 pp. 2004-2013.
Latchman et al. "PD-L2 is a second ligand for PD-1 and inhibits T cell activation", Nat Immunol (2001) vol. 2 No. 3 pp. 261-268.
Lee et al. "Xenograft models for the preclinical evaluation of new therapies in acute leukemia" Leukemia & Lymphoma (2007) vol. 48, No. 4, pp. 659-668.
Lee et al., "In vivo Inhibition of Human CD19-Targeted Effector T Cells by Natural T Regulatory Cells in a Xenotransplant Murine Model of B Cell Malignancy" Cancer Research (2011) vol. 71 No. 8 pp. 2871-2881.
Lee et al., "The Future is Now: Chimeric Antigen Receptors as New Targeted Therapies for Childhood Cancer," Clin. Cancer Res. 18: 2780-2790 (2012).
Letourneur et al., "T-cell and basophil activation through the cytoplasmic tail of T-cell-receptor zeta family proteins," Proc. Natl. Acad. Sci. U.S.A 88: 8905-8909 (1991).
Levine et al., "Gene transfer in humans using a conditionally replicating lentiviral vector" PNAS (2006) vol. 103 No. 46 pp. 17372-17377.
Lim et al., "Anti-CD20 monoclonal antibodies: historical and future perspectives." Haematologica (2010) vol. 95 No. 1 pp. 135-143.
Liu et al., "Calcineurin is a common target of cyclophilin-cyclosporin A and FKBP-FK506 complexes." Cell (1991) vol. 66 No. 4 pp. 807-815.
MacAllan et al., "Measurement and modeling of human T cell kinetics" European Journal of Immunology (2003) vol. 33 pp. 2316-2326.
Maher et al., "Human T lymphocyte cytotoxicity and proliferation directed by a single chimeric TCRzeta/CD28 receptor," Nat. Biotechnol. 20: 70-75 (2002).
Martz et al. "Overcoming ibrutinib resistance" SciBX (2014) vol. 7, No. 33, pp. 1-3.
Marzec et al., "Mantle cell lymphoma cells express predominantly cyclin D1a isoform and are highly sensitive to selective inhibition of CDK4 kinase activity." Blood (2006) vol. 108 No. 5 pp. 1744-1750.
Mato et al., "Favorable Outcomes in CLL Pts with Alternate Kinase Inhibitors Following Ibrutinib or Idelalisib Discontinuation: Results from a Large Multi-Center Study" Blood (2015) vol. 126 No. 23.
Mato et al., "Ibrutinib-induced pneumonitis in patients with chronic lymphocyticleukemia" Blood (2016) vol. 127 No. 8 pp. 1064-1067.
Maude et al., "Chimeric Antigen Receptor T Cells for Sustained Remissions in Leukemia" The New England Journal of Medicine (2014) vol. 371 No. 16 pp. 1507-1517.
Maude, "217 Efficacy of Humanized CD19-Targeted Chimeric Antigen Receptor (CAR)-Modified T Cells in Children and Young Adults with Relapsed/Refractory Acute Lymphoblastic Leukemia" 58th Annual Meeting & Exposition—Dec. 3, 2016; Abstract.
McGuinness et al., "Anti-tumor activity of human T cells expressing the CC49-zeta chimeric immune receptor," Hum. Gene Ther. 10: 165-173 (1999).
Mihara et al. "Synergistic and 1,2,5-36 persistent effect of T-cell imnunotherapy with anti-CD19 or anti-CD38 chimeric receptor in conjunction with rituximab on B-cell non-Hodgkin lymphoma" British Journal of Haematology (2010) vol. 151, No. 1, pp. 37-46.
Milone et al, "Chimeric Receptors Containing CD137 Signal Transduction Domains Mediate Enhanced Survival of T Cells and Increased Antileukemic Efficacy In Vivo" Molecular Therapy (2009) vol. 17 No. 8 pp. 1453-1464.
Milone et al, Supplementary Materials and Methods, Mol. Ther (2009) vol. 17, 7 pages.

(56) References Cited

OTHER PUBLICATIONS

Moeini et al., "Emerging signaling pathways in hepatocellular carcinoma." Liver Cancer (2012) vol. 1 No. 2 pp. 83-93.
Molina, "A Decade of Rituximab: Improving Survival Outcomes in Non-Hodgkin's Lymphoma" Annu. Rev. Med. (2008) vol. 59 pp. 237-250.
Morgan et al., "Case Report of a Serious Adverse Event Following the Administration of T Cells Transduced With a Chimeric Anitgen Receptor Recognizing ErbB2," Mol. Ther. 18(4): 843-851 (2010).
Moritz and Groner, "A spacer region between the single chain antibody—and the CD3 zeta-chain domain of chimeric T cell receptor components is required for efficient ligand binding and signaling activity," Gene Therapy 2(8): 539-546 (1995).
Moritz et al., "Cytotoxic T lymphocytes with a grafted recognition specificity for ERBB2-expressing tumor cells" Proc. Natl. Acad. Sci (1994) vol. 91 pp. 4318-4322.
Naldini et al., "In Vivo Gene Delivery and Stable Transduction of Nondividing Cells by a Lentiviral Vector" Science (1996) vol. 272 pp. 263-267.
NCBI accession HM_852952 accessed Sep. 29, 2015 from http://www.ncbi.nlm.nih.gov/nuccore/hm852952.
Acuto et al. "CD28-Mediated Co-Stimulation: A Quantitative Support for TCR Signalling" Nature Reviews Immunology (2003) vol. 3, pp. 939-951.
Akiba et al. "CD27, a Member of the Tumor Necrosis Factor Receptor Superfamily, Activates NF-kB and Stress-activated Protein Kinase/c-Jun N-terminal Kinase via TRAF2, TRAF5, and NF-kB-inducing Kinase" The Journal of Biological Chemistry (1998) vol. 273, No. 21, pp. 13353-13358.
Alabanza et al. "Function of Novel Anti-CD19 Chimeric Antigen Receptors with Human Variable Regions Is Affected by Hinge and Transmembrane Domains" Molecular Therapy (2017) vol. 25, No. 11, pp. 1-14.
Bridgeman et al. "The Optimal Antigen Response of Chimeric Antigen Receptors Harboring the CD3 Transmembrane Domain Is Dependent upon Incorporation of the Receptor into the Endogenous TCR/CD3 Complex" J. Immunol. (2010) vol. 184, pp. 6938-6949.
Cheadle et al "Natural Expression of the CD19 Antigen Impacts the Long-Term Engraftment but Not Antitumor Activity of CD19-Specific Engineered T Cells" The Journal of Immunology (2010) vol. 184, No. 4, pp. 1885-1896.
Diamond et al. "Somatic mutation of the T15 heavy chain gives rise to an antibody with autoantibody specificity" PNAS (1984) vol. 81, pp. 5841-5844.
GenBank Accession No. NM_000734 "*Homo sapiens* CD247 molecule (CD247), transcript variant 2, mRNA" Dec. 7, 2009.
Guest et al. "The Role of Extracellular Spacer Regions in the Optimal Design of Chimeric Immune Receptors Evaluation of Four Different scFvs and Antigens" J. Immunother. (2005) vol. 28, No. 3, pp. 203-211.
International Preliminary Report on Patentability for International Application No. PCT/US2015/055764 dated Apr. 18, 2017.
International Search Report and Written Opinion for International Application No. PCT/US2015/055764 dated Jan. 20, 2016.
Irving et al. "Functional Characterization of a Signal Transducing Motif Present in the T Cell Antigen Receptor Chain" Journal of Experimental Medicine (1993) vol. 177, pp. 1093-1103.
Jang et al. "Human 4-1BB (CD137) Signals Are Mediated by TRAF2 and Activate Nuclear Factor-kB" Biochemical and Biophysical Research Communications (1998)) vol. 242, pp. 613-620.
Jena et al. "Chimeric Antigen Receptor (CAR)-Specific Monoclonal Antibody to Detect CD19-Specitic T Cells in Clinical Trials" PLOS ONE (2013) vol. 8, No. 3, e57838, pp. 1-12.
Kharfan-Dabaja et al. "Immunotherapy for chronic lymphocytic leukemia in the era of BTK inhibitors" Leukemia (2014) vol. 28, pp. 507-517.
Ohno, et al. "Antigen-binding specificities of antibodies are preimarily determined by seven residues of VH" PNAS (1985) vol. 82, pp. 2945-2949.
Parry et al. "CD28 and Inducible Costimulatory Protein Src Homology 2 Binding Domains Show Distinct Regulation of Phisphatidylinositol 3-Kinase, Bcl-xL, and IL-2 Expession in Primary Human CD4 T Lymphocytes" The Journal of Immunology (2003) vol. 171, pp. 166-174.
Singapore search report and written opinion for Singapore Application No. 11201506603P dated May 31, 2017.
Singapore Search Report and Written Opinion for Singapore Application No. 11201606909R dated Oct. 24, 2017.
Singapore Search Report for Singapore Application No. 11201708191X dated May 15, 2018.

\* cited by examiner

Bi-Specific CD19/22 CAR mo;ecule design

*CARTs were normalized to same number of CAR-pos (3.75e6/mouse)

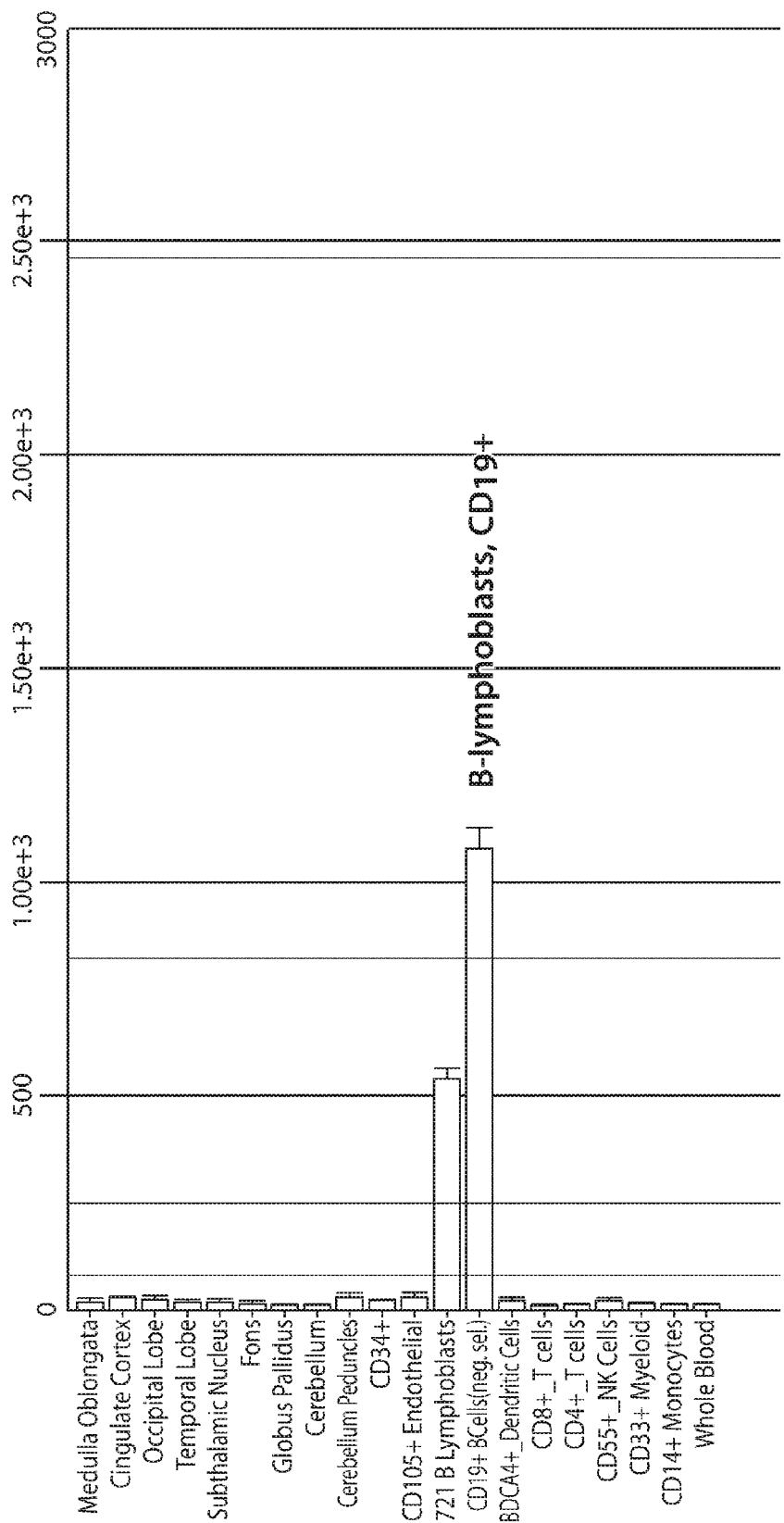

CD20 THERAPIES, CD22 THERAPIES, AND COMBINATION THERAPIES WITH A CD19 CHIMERIC ANTIGEN RECEPTOR (CAR)-EXPRESSING CELL

This application claims priority to U.S. Ser. No. 62/144,615 filed Apr. 8, 2015, U.S. Ser. No. 62/144,497 filed Apr. 8, 2015 U.S. Ser. No. 62/144,639 filed Apr. 8, 2015, U.S. Ser. No. 62/207,255 filed Aug. 19, 2015, U.S. Ser. No. 62/263,423 filed Dec. 4, 2015, the contents of which are incorporated herein by reference in their entireties.

SEQUENCE LISTING

The instant application contains a Sequence Listing which has been submitted electronically in ASCII format and is hereby incorporated by reference in its entirety. Said ASCII copy, created on Apr. 29, 2016, is named N2067-707210_SL.txt and is 1,840,044 bytes in size.

FIELD OF THE INVENTION

The present invention relates generally to the use of T cells engineered to express a Chimeric Antigen Receptor (CAR), optionally in combination with a B cell inhibitor, e.g., one or more inhibitors of CD10, CD19, CD20, CD22, CD34, CD123, FLT-3, ROR1, CD79b, CD179b, or CD79a to treat a disease associated with expression of the Cluster of Differentiation 19 protein (CD19).

BACKGROUND OF THE INVENTION

Many patients with B cell malignancies are incurable with standard therapy. In addition, traditional treatment options often have serious side effects. Attempts have been made in cancer immunotherapy, however, several obstacles render this a very difficult goal to achieve clinical effectiveness. Although hundreds of so-called tumor antigens have been identified, these are generally derived from self and thus are poorly immunogenic. Furthermore, tumors use several mechanisms to render themselves hostile to the initiation and propagation of immune attack.

Recent developments using chimeric antigen receptor (CAR) modified autologous T cell (CART) therapy, which relies on redirecting T cells to a suitable cell-surface molecule on cancer cells such as B cell malignancies, show promising results in harnessing the power of the immune system to treat B cell malignancies and other cancers (see, e.g., Sadelain et al., Cancer Discovery 3:388-398 (2013)). The clinical results of the murine derived CART19 (i.e., "CTL019") have shown promise in establishing complete remissions in patients suffering with CLL as well as in childhood ALL (see, e.g., Kalos et al., Sci Transl Med 3:95ra73 (2011), Porter et al., NEJM 365:725-733 (2011), Grupp et al., NEJM 368:1509-1518 (2013)). Besides the ability for the chimeric antigen receptor on the genetically modified T cells to recognize and destroy the targeted cells, a successful therapeutic T cell therapy needs to have the ability to proliferate and persist over time, in order to survey for leukemic relapse. The variable quality of T cells, resulting from anergy, suppression, or exhaustion, will have effects on CAR-transformed T cells' performance, over which skilled practitioners have limited control at this time. To be effective, CAR transformed patient T cells need to persist and maintain the ability to proliferate in response to the cognate antigen. It has been shown that ALL patient T cells perform can do this with CART19 comprising a murine scFv (see, e.g., Grupp et al., NEJM 368:1509-1518 (2013)).

SUMMARY OF THE INVENTION

The disclosure features, at least in part, a method of treating a disorder associated with expression of the Cluster of Differentiation 19 protein (CD19) (e.g., OMIM Acc. No. 107265, Swiss Prot. Acc No. P15391). In certain embodiments, the disorder is a cancer, e.g., a hematological cancer. In some embodiments, the method comprises administering a Chimeric Antigen Receptor (CAR) molecule that binds CD19 in combination with a B-cell inhibitor, for example, one or more (e.g., one, two, three or more) B-cell inhibitors. In some embodiments, the B-cell inhibitor is chosen from an inhibitor of CD10, CD19, CD20, CD22, CD34, CD123, FLT-3, or ROR1, or a combination thereof. In some embodiments, the combination maintains or has better clinical effectiveness as compared to either therapy alone. In some embodiments, the methods herein involve the use of engineered cells, e.g., T cells, to express a CAR molecule that binds CD19, in combination with a B-cell inhibitor (e.g., an antibody (e.g., a mono- or bispecific antibody) to a second B target, e.g., CD10, CD19, CD20, CD22, CD34, CD123, FLT-3, or ROR1) or a CAR-expressing cell e.g., a CAR-expressing immune effector cell, that binds to the second B cell target, or a combination thereof) to treat the disorder associated with expression of CD19. The disclosure additionally features novel antigen binding domains and CAR molecules directed to CD20 and CD22, and uses, e.g., as monotherapies or in combination therapies.

Accordingly, in one aspect, the invention pertains to a method of treating a subject (e.g., a mammal) having a disease associated with expression of CD19. The method comprises administering to the subject a CD19 inhibitor, e.g., a CAR molecule that binds CD19 described herein, in combination with a B-cell inhibitor. For instance, the method comprises administering to the subject an effective number of one or more cells that express a CAR molecule that binds CD19, e.g., a CAR molecule that binds CD19 described herein (e.g., a wild-type or mutant CD19), in combination with a B-cell inhibitor. In certain embodiments, the B-cell inhibitor is chosen from a CD10 inhibitor, e.g., one or more CD10 inhibitors described herein; a CD20 inhibitor, e.g., one or more CD20 inhibitor described herein; a CD22 inhibitor, e.g., one or more CD22 inhibitors described herein; a CD34 inhibitor, e.g., one or more CD34 inhibitors described herein; a CD123 inhibitor, e.g., one or more CD123 inhibitor described herein; a FLT-3 inhibitor, e.g., one or more FLT-3 inhibitors described herein; an ROR1 inhibitor, e.g., one or more ROR1 inhibitor described herein; a CD79b inhibitor, e.g., one or more CD79b inhibitor described herein; a CD179b inhibitor, e.g., one or more CD179b inhibitor described herein; a CD79a inhibitor, e.g., one or more CD79a inhibitor described herein or any combination thereof. In certain aspects, a method of treating a subject having a B-cell leukemia or B-cell lymphoma, comprising administering to the subject an effective number of one or more cells that express a CAR molecule that binds CD19, in combination with one or more inhibitors of CD10, CD20, CD22, CD34, CD123, FLT-3, ROR1, CD79b, CD179b, or CD79a is disclosed.

In a related aspect, the present disclosure provides a method of reducing the proliferation of CD19-expressing cells, e.g., by administering to a subject, e.g., a patient in need thereof, a combination therapy as described herein, e.g., a CD19 inhibitor in combination with a B-cell inhibitor, e.g., one or more B-cell inhibitors as described herein. In another aspect, the present disclosure provides a method of selectively killing CD19-expressing cells, e.g., by administering to a subject, e.g., a patient in need thereof, a combination therapy as described herein, e.g., a CD19 inhibitor in combination with a B-cell inhibitor, e.g., one or more B-cell inhibitors as described herein. In certain aspects, the disclosure provides a method of providing an anti-tumor immunity in a subject, e.g., a mammal, comprising administering to the mammal an effective amount of a combination (e.g., one or more CAR-expressing cells) as described herein.

In an aspect, the disclosure provides a method of preventing a CD19-negative relapse in a mammal, comprising administering to the mammal one or more B-cell inhibitors, wherein the B-cell inhibitor comprises an inhibitor of one or more of CD10, CD20, CD22, CD34, CD123, FLT-3, ROR1, CD79b, CD179b, or CD79a.

In another aspect, the disclosure provides a method of treating a subject having a disease associated with expression of CD19, e.g., DLBCL (e.g. primary DLBCL). The method comprises administering to the subject an effective number of one or more cells that express a CAR molecule that binds CD19, e.g., a CD19 CAR, optionally in combination with a PD1 inhibitor. Optionally, the subject has, or is identified as having, at least 5%, 6%, 7%, 8%, 9%, 10%, 20%, 30%, 40%, 50%, 60%, 70%, 80%, or 90% of cancer cells, e.g., DLBCL cells, which are CD3+/PD1+.

In an aspect, the disclosure provides a method of treating a subject having a disease associated with expression of CD19, e.g., DLBCL. The method comprises administering to the subject an effective number of one or more cells that express a CAR molecule that binds CD19, e.g., a CD19 CAR, in combination with a PD-L1 inhibitor. Optionally, the subject has, or is identified as having, less than 20%, 10%, 9%, 8%, 7%, 6%, 5%, 4%, 3%, 2%, or 1% of cells in the cancer, e.g., cancer microenvironment, are double positive for CD19 and PD-L1.

In an aspect, the disclosure provides one or more B-cell inhibitors, wherein the B-cell inhibitor comprises an inhibitor of one or more of CD10, CD20, CD22, CD34, CD123, FLT-3, ROR1, CD79b, CD179b, or CD79a, for use in the treatment of a subject having a disease associated with expression of CD19, and wherein said subject has received, is receiving or is about to receive a cell that expresses a CAR molecule that binds CD19, e.g., a CD19 CAR.

Timing and Dosage of the Combination Administration

The one or more therapies described herein can be administered to the subject substantially at the same time or in any order. For instance, a CD19 inhibitor, e.g., a CD19 CAR-expressing cell described herein, the one or more B-cell inhibitor, and/or optionally the at least one additional therapeutic agent can be administered simultaneously, in the same or in separate compositions, or sequentially.

For sequential administration, the CAR-expressing cell described herein (e.g., a CD19 CAR-expressing cell, a CD20 CAR-expressing cell, or a CD22 CAR-expressing cell) can be administered first, and the additional agent can be administered second, or the order of administration can be reversed. In some embodiments, the first therapy (e.g., a CAR-expressing cell such as a CD19 CART cell, CD20 CART cell, or CD22 CART cell) is continued when the second therapy is introduced, and in other embodiments the first therapy is withdrawn before, after, or at the same time as the second therapy is introduced. In instances of sequential administration, in some embodiments, the second therapy is initiated after a predetermined amount of time, or after the subject displays one or more indications that relapse has occurred or is likely to occur. The indication can be, e.g., the presence of cancer cells having a disturbance in the target of the first therapy, e.g., CD19, CD20, or CD22. The disturbance may be, e.g., a frameshift mutation and/or a premature stop codon.

In other embodiments, the two or more therapies (e.g., a CD19 CAR-expressing cell and a B-cell inhibitor) are administered simultaneously. Without being bound by theory, in some embodiments, simultaneous administration of the therapies can reduce the likelihood of relapse and/or delay relapse.

When administered in combination, the first therapy (e.g., CAR therapy, e.g., CAR-expressing cell directed against CD19, CD20, or CD22) and the additional agent (e.g., second or third agent, e.g., a B-cell inhibitor), or all, can be administered in an amount or dose that is higher, lower, or the same as the amount or dosage of each agent used individually, e.g., as a monotherapy. In certain embodiments, the administered amount or dosage of the first therapy, second therapy, optionally a third therapy, or all, is lower (e.g., at least 20%, at least 30%, at least 40%, or at least 50%) than the amount or dosage of each agent used individually, e.g., as a monotherapy. In other embodiments, the amount or dosage of the first therapy, second therapy, optionally a third therapy, or all, that results in a desired effect (e.g., treatment of cancer) is lower (e.g., at least 20%, at least 30%, at least 40%, or at least 50% lower) than the amount or dosage of each agent used individually, e.g., as a monotherapy, required to achieve the same therapeutic effect. In certain embodiments, the lower dose results in reduced side effects compared to those seen when the regular (monotherapy) dose is administered.

In an embodiment, the therapy comprises a population of cells. In embodiments, the cells are immune effector cells, e.g., CAR-expressing cells.

Alternatively, or in combination with the methods described herein, methods are disclosed that comprise a diagnostic step or a patient selection step, for instance as described below.

In one aspect, the invention provides a method of evaluating a subject, e.g., a patient, for relapser status (e.g. a relapser or a non-relapser after a CAR-therapy). In one embodiment, the method identifies a subject, e.g., a patient, who has relapsed ("relapser") or who is are likely to relapse, or who has not relapsed ("non-relapser") or who is likely not to relapse, after treatment with a CAR therapy (e.g., a CD19 CART therapy, e.g., described herein, e.g., a CTL019 therapy). In an embodiment, relapser status (e.g. relapser or non-relapser after a CART therapy) is determined by assaying for one or more characteristics of CD19.

In one embodiment, the one or more characteristics of CD19 include an alteration in a nucleic acid sequence (e.g., a mutation such as an insertion, a deletion, or a substitution, or a combination thereof), an alteration in a nucleic acid level, an alteration in a protein sequence, or an alteration in a protein level, or a combination thereof. In one embodiment, a relapser has one or more mutations in CD19, e.g., one or more mutations (e.g. insertions or deletions) in exon 2 of CD19. In an embodiment, a relapser has one or more mutations in exon 1, exon 2, exon 3, exon 4, exon 5, exon 6, or exon 7 of CD19. In an embodiment, the mutation produces a premature stop codon, e.g., by an insertion or deletion leading to a frameshift, e.g., in exon 2 of CD19. In an embodiment, the mutation is a mutation of Table 31.

In an embodiment, the characteristic of CD19 is compared to a reference characteristic. For example, when the characteristic is a sequence (e.g., protein or nucleic acid sequence from a biological sample), the reference characteristic can be a wild-type sequence (e.g., protein or nucleic acid sequence) of CD19. The characteristic may be the percent of cells in the sample having a mutant sequence. When the characteristic is a level (e.g., protein or nucleic acid level), the reference characteristic can be a wild-type level (e.g., protein or nucleic acid level) of CD19. The characteristic may be the level of protein or nucleic acid in the sample. The characteristic may be the percentage of cells in the sample that have a level of protein or nucleic acid that is above a given threshold.

In an embodiment, methods are provided for identifying a subject having cancer, e.g., a hematological cancer, such as, e.g., CLL or ALL, as being a relapser or non-relapser after a treatment that comprises a CAR therapy, e.g., a CD19 CART therapy. The method comprises: (1) acquiring a sample from the subject (e.g., an apheresis sample obtained from the blood of the subject; and/or e.g., a manufactured product sample, e.g., genetically engineered T cells obtained from the blood of the subject); (2) determining a characteristic of CD19, e.g., a sequence or level as described herein; and (3) (optionally) comparing the determined characteristic of CD19 to a reference characteristic; wherein the difference, e.g., statistically significant difference, between the determined characteristic compared to the reference characteristic is predictive of relapse to the CAR therapy; and (4) identifying the subject as a relapser or non-relapser to the CAR therapy, e.g., based on the determined characteristic of CD19. In one embodiment, the presence or absence of the characteristic of CD19 is the presence or absence of a premature stop codon, e.g., by an insertion or deletion leading to a frameshift. In an embodiment, the presence of the characteristic of CD19 is a mutation of Table 31.

In an embodiment, the provided methods comprise (1) acquiring a sample from the subject (e.g., an apheresis sample obtained from the blood of the subject; and/or, e.g., a manufactured product sample, e.g., genetically engineered T cells obtained from the blood of the subject, e.g., a manufactured CART19 product); (2) determining a characteristic of CD19, e.g., a sequence or level as described herein; and (3) (optionally) comparing the determined characteristic of CD19 to a reference characteristic; wherein the presence of the characteristic of CD19 (e.g., the difference, e.g., a statistically significant difference, between the determined characteristic compared to the reference characteristic) is predictive of relapse to the CAR therapy. In one embodiment, the presence of the characteristic of CD19 is the presence of a premature stop codon, e.g., by an insertion or deletion leading to a frameshift. In an embodiment, the presence of the characteristic of CD19 is a mutation of Table 31.

In an embodiment, methods are provided for determining the relapse of a subject having cancer, e.g., a hematological cancer such as CLL or ALL, after a treatment comprising a CAR therapy, e.g., a CD19 CAR therapy as described herein. The method comprises determining a characteristic of CD19 in a sample obtained prior to relapse. In an embodiment, the presence of the characteristic of CD19 (e.g., the difference, e.g., a statistically significant difference, between the determined characteristic compared to the reference characteristic) is indicative of relapse after CAR therapy. In one embodiment, the presence of the characteristic of CD19 is the presence of a premature stop codon, e.g., by an insertion or deletion leading to a frameshift. In an embodiment, the presence of the characteristic of CD19 is a mutation of Table 31.

In an embodiment, methods are provided for evaluating a subject having cancer, e.g., a hematological cancer such as CLL or ALL. The method comprises acquiring a value of relapser status for the subject that comprises a measure of one or characteristics of CD19, e.g., one or more of the characteristics of CD19 as described herein, thereby evaluating the subject.

In an embodiment, methods are provided for evaluating or monitoring the effectiveness of a CAR therapy, e.g., a CD19 CART therapy, in a subject having cancer comprising acquiring a value of relapser status for the subject that comprises a measure of one or more characteristic of CD19, e.g., one or more of the characteristics of CD19 as described herein, thereby evaluating or monitoring the effectiveness of the CAR therapy in the subject.

In an embodiment, methods are provided for providing a prediction for success rate of a CAR therapy, e.g., a CD19 CART therapy, e.g., described herein, in a subject having cancer, said method comprising steps of providing a biological sample from the subject; determining one or more characteristic of CD19, e.g., one or more of the characteristics of CD19 as described herein; and based on the characteristic determined, providing a prognosis to the subject.

In some aspects, the present disclosure provides, e.g., a method of, or assay for, identifying a subject having cancer as having an increased or decreased likelihood to respond to a treatment that comprises a chimeric antigen receptor (CAR) therapy, the method comprising:
(1) acquiring a sample from the subject;
(2) determining a value for one or more of:
   (i) a level of one or more markers listed in Table 29 in the sample;
   (ii) a characteristic of CD19, e.g., a mutation, e.g., a mutation causing a frameshift or a premature stop codon or both, or
   (iii) a level or activity of $T_{REG}$ cells; and
(3) (optionally) comparing the determined value, e.g., the level, activity or characteristic of (i), (ii) or (iii) or a combination thereof, to a reference value, wherein the difference, e.g., a statistically significant difference, between the determined value compared to the reference value, is predictive of the subject's responsiveness to the CAR therapy; and
(4) identifying the subject as a complete responder, partial responder or non-responder, or relapse or non-relapser to the CAR therapy based on the determined value.

In certain embodiments, any of the aforesaid methods can further include the following:
   (i) administering to the subject a therapeutically effective dose of a CAR therapy, e.g., a therapy comprising a CD19-expressing cell, if no difference, e.g., no statistically significant difference, is detected in the value for one, two or more (all) of (i) the level or activity of one or more markers listed in Table 29; (ii) the characteristic of CD19, e.g., a mutation, e.g., a mutation causing a frameshift or a premature stop codon or both, or (iii) the level of $T_{REG}$ cells in a biological sample;
   (ii) administering to the subject a therapeutically effective dose of a CAR therapy, e.g., a therapy comprising a CD19-expressing cell and one or more B-cell inhibitor (e.g., one or more inhibitors of CD10, CD20, CD22, CD34, CD123, FLT-3, or ROR1 as described herein), if a difference, e.g., a statistically significant difference, is detected in the value for one, two or more (all) of (i) the level or activity of one or more markers listed in Table 29; (ii) the characteristic of CD19, e.g., a mutation, e.g., a mutation causing a frameshift or a premature stop codon or both, or (iii) the level of $T_{REG}$ cells in a biological sample; or (iii) discontinuing a first therapy, e.g., a therapy comprising a CD19-expressing cell, and administering a second therapy, e.g., one or more B-cell inhibitor (e.g., one or more inhibitors of CD10, CD20, CD22, CD34, CD123, FLT-3, or ROR1 as described herein), if a difference, e.g., a statistically significant difference, is detected in the value for one, two or more (or all) of (i) the level or activity of one or more markers listed in Table 29; (ii) the characteristic of CD19, e.g., a mutation, e.g., a mutation causing a frameshift or a premature stop codon or both, or (iii) the level of $T_{REG}$ cells in a biological sample.

The administration steps (i)-(iii) can be performed before or after the patient evaluation steps, as described in exemplary embodiments below.

In certain aspects, a method for treating a subject having cancer is disclosed. The method comprises:

(a) acquiring, e.g., determining, if the subject has a value for one, two or more (all) of:
  (i) a level of one or more markers listed in Table 29;
  (ii) a characteristic of CD19, e.g., a mutation causing a frameshift or a premature stop codon or both, or
  (iii) a level or activity of $T_{REG}$ cells in a biological sample, and (b) responsive to said value, further include the following:
  (i) administering to the subject a therapeutically effective dose of a CAR therapy, e.g., a therapy comprising a CD19-expressing cell, if no difference, e.g., no statistically significant difference, is detected in one, two or more (or all) of (i) the level or activity of one or more markers listed in Table 29; (ii) the characteristic of CD19, e.g., a mutation, e.g., a mutation causing a frameshift or a premature stop codon or both, or (iii) the level of $T_{REG}$ cells in a biological sample;
  (ii) administering to the subject a therapeutically effective dose of a CAR therapy, e.g., a therapy comprising a CD19-expressing cell and one or more B-cell inhibitor (e.g., one or more inhibitors of CD10, CD20, CD22, CD34, CD123, FLT-3, or ROR1 as described herein), if a difference, e.g., a statistically significant difference, is detected in one, two or more (or all) of (i) the level or activity of one or more markers listed in Table 29; (ii) the characteristic of CD19, e.g., a mutation, e.g., a mutation causing a frameshift or a premature stop codon or both, or (iii) the level of $T_{REG}$ cells in a biological sample; or
  (iii) discontinuing a first therapy, e.g., a therapy comprising a CD19-expressing cell, and administering a second therapy, e.g., one or more B-cell inhibitor (e.g., one or more inhibitors of CD10, CD20, CD22, CD34, CD123, FLT-3, or ROR1 as described herein), if a difference, e.g., a statistically significant difference, is detected in one or more of (i) the level or activity of one or more markers listed in Table 29; (ii) the characteristic of CD19, e.g., a mutation, e.g., a mutation causing a frameshift or a premature stop codon or both, or (iii) the level of $T_{REG}$ cells in a biological sample.

In another aspect, a method for treating a subject having cancer is provided. The method includes:

(a) administering to a subject a therapeutically effective dose of a CAR therapy, e.g., a therapy comprising a CD19-expressing cell, (b) acquiring a value for (e.g., determining if the subject has), one, two or more (all) of:
  (I) a level of one or more markers listed in Table 29;
  (II) a characteristic of CD19, e.g., a mutation, e.g., a mutation causing a frameshift or a premature stop codon or both, or
  (III) a level or activity of $T_{REG}$ cells in a biological sample, and (c) in response to the value or determination in step (b) (I-III), performing one or more of the following:
  (i) administering to the subject a therapeutically effective dose of a CAR therapy, e.g., a therapy comprising a CD19-expressing cell, if no difference, e.g., no statistically significant difference, is detected in one or more of (I) the level or activity of one or more markers listed in Table 29; (II) the characteristic of CD19, e.g., a mutation, e.g., a mutation causing a frameshift or a premature stop codon or both, or (III) the level of $T_{REG}$ cells in a biological sample;
  (ii) administering to the subject a therapeutically effective dose of a CAR therapy, e.g., a therapy comprising a CD19-expressing cell and one or more B-cell inhibitor (e.g., one or more inhibitors of CD10, CD20, CD22, CD34, CD123, FLT-3, or ROR1 as described herein), if a difference, e.g., a statistically significant difference, is detected in one or more of (I) the level or activity of one or more markers listed in Table 29; (II) the characteristic of CD19, e.g., a mutation, e.g., a mutation causing a frameshift or a premature stop codon or both, or (III) the level of $T_{REG}$ cells in a biological sample; or
  (iii) discontinuing a first therapy, e.g., a therapy comprising a CD19-expressing cell, and administering a second therapy, e.g., one or more B-cell inhibitor (e.g., one or more inhibitors of CD10, CD20, CD22, CD34, CD123, FLT-3, or ROR1 as described herein), if a difference, e.g., a statistically significant difference, is detected in one or more of (I) the level or activity of one or more markers listed in Table 29; (II) the characteristic of CD19, e.g., a mutation, e.g., a mutation causing a frameshift or a premature stop codon or both, or (III) the level of $T_{REG}$ cells in a biological sample.

In some embodiments of any of the aforesaid methods, the sample is a biological sample selected from a blood, plasma, or a serum sample. In a particular embodiment, a biological sample is a blood sample. In one embodiment, the sample is an apheresis sample, e.g., T cells obtained from the blood of the subject. In an embodiment, the sample is a manufactured product sample, e.g. genetically engineered T cells obtained from the blood of the subject, e.g., a manufactured CAR product, e.g., a manufactured CART19 product.

In an embodiment, the methods herein can be used to determine if a patient is likely to respond to CAR therapy (e.g., CD19 CART), e.g., if a patient who has not received CAR therapy is likely to respond to CAR therapy, or if a patient who has received CAR therapy is likely to respond to continued CAR therapy. In general, the same CD19 characteristics that predict relapse predict that a patient is less likely to respond to a CD19 CAR therapy. A patient who is identified as less likely to respond to a CD19 CAR therapy can be administered a different type of therapy, such as B-cell inhibitor (e.g., one or more inhibitors of CD10, CD20, CD22, CD34, CD123, FLT-3, ROR1, CD79b, CD179b, or CD79a as described herein).

In another aspect, a method for treating a subject having cancer, e.g., a hematological cancer, is provided. In an embodiment, the method includes determining if a subject has a difference, e.g., statistically significant difference, in a characteristic of CD19 relative to a reference characteristic, and if there is a difference, e.g., statistically significant difference between the determined characteristic and reference characteristic, administering to the subject a therapeutically effective dose of a CAR therapy, e.g., CART, thereby treating the subject. In an embodiment, the characteristic is CD19 sequence, e.g., protein or nucleic acid sequence. In an embodiment, the method comprises assaying for the presence or absence of frameshifted CD19, e.g., CD19 comprising a premature stop codon.

In embodiments of any of the aforesaid methods, the treatment comprises administering a CD19 CAR-expressing cell, optionally in combination with one or more B-cell inhibitors. In an embodiment, the CD19 CAR therapy is administered simultaneously with one or more B-cell inhibitors (e.g., one or more inhibitors of CD10, CD20, CD22, CD34, CD123, FLT-3, ROR1, CD79b, CD179b, or CD79a as described herein). In an embodiment, the CD19 CAR therapy is administered before the one or more of B-cell inhibitors. In an embodiment, the CD19 CAR therapy is administered after the one or more of B-cell inhibitors.

In an embodiment, wherein there is a difference between the determined characteristic and reference characteristic, the method comprises modifying the CAR product prior to infusion into the subject. In an embodiment, wherein there is a different between the determined characteristic and the reference characteristic, the method comprises modifying the manufacture of a CAR product prior to infusion into the subject. In an embodiment, if there is a difference between the determined characteristic and reference characteristic the method comprises adjusting the CAR infusion dose to achieve an anticancer effect.

In an embodiment, the methods of treatment comprise determining if a subject has an increased likelihood to respond to a CAR therapy, e.g., a CD19 CART therapy, e.g., a CD19 CART therapy described herein, by comparing a characteristic of CD19 in a sample from the subject relative to a reference characteristic, wherein a difference in the characteristic relative to the reference characteristic is indicative of an increased likelihood of response; and administering to the subject a therapeutically effective dose of a CAR therapy, thereby treating the subject.

In an embodiment, the methods of treatment comprise obtaining a sample from a subject; determining a characteristic of CD19 (e.g., the presence or absence of a frameshift or premature stop codon), relative to a reference characteristic; and administering a therapeutically effective dose of a CAR expressing cell, if the subject is identified as having a statistically significant difference between the CD19 characteristic of the sample and a reference characteristic in the sample.

The CD19 characteristic can be used to design a treatment for the patient. For example, in an embodiment, when a patient sample comprises wild-type CD19, the patient is administered a CD19 inhibitor, e.g., a CD19 CAR-expressing cell, e.g., a CD19 CART. In an embodiment, when a patient sample comprises mutant CD19, e.g., frameshifted CD19, e.g., CD19 comprising a premature stop codon, the patient is administered a therapy other than a CD19 inhibitor, e.g., the patient is administered another B-cell inhibitor. In an embodiment, when a patient sample comprises at least normal levels of CD19, the patient is administered a CD19 inhibitor, e.g., a CD19 CAR-expressing cell, e.g., a CD19 CART. In an embodiment, when a patient sample comprises lower than normal levels of CD19, the patient is administered a therapy other than a CD19 inhibitor, e.g., the patient is administered another B-cell inhibitor (e.g., one or more inhibitors of CD10, CD20, CD22, CD34, CD123, FLT-3, ROR1, CD79b, CD179b, or CD79a as described herein).

In an embodiment, the methods of treatment comprise acquiring a value of relapser status for the subject that comprises a measure of a CD19 characteristic, and responsive to a determination of relapser status, performing one, two, three four or more of: (1) identifying the subject as a relapse or non-relapser; (2) administering a CAR therapy; (3) selecting or altering a dosing of a CAR therapy; (4) selecting or altering the schedule or time course of a CAR therapy; (5) administering, e.g., to a relapser, an additional agent in combination with the CAR therapy, e.g., administering one or more B-cell inhibitors; or a checkpoint inhibitor, e.g., a checkpoint inhibitor described herein, or a kinase inhibitor, e.g., a kinase inhibitor described herein; (6) administering to a relapser a therapy that increases the number of naïve T cells in the subject prior to treatment with a CAR therapy; modifying a manufacturing process of a CAR therapy, e.g., enrich for naïve T cells prior to introducing a nucleic acid encoding a CAR, e.g., for a subject identified as a relapser; or (7) selecting an alternative therapy, e.g., a standard of care for a particular cancer (e.g., as described herein), e.g., for a relapser; thereby treating cancer in the subject.

In some embodiments, the method comprises administering one, two, three or more B-cell inhibitors (e.g., one or more inhibitors of CD10, CD20, CD22, CD34, CD123, FLT-3, or ROR1 as described herein). For instance, in an embodiment, the method includes administering a CD19 inhibitor, e.g., a cell expressing a CD19 CAR, in combination with a CD10 inhibitor, or any combination of a CD10 inhibitor and an inhibitor of CD20, CD22, CD34, CD123, FLT-3, or ROR1 as described herein. In another embodiment, the method includes administering a CD19 inhibitor, e.g., a cell expressing a CD19 CAR, in combination with a CD20 inhibitor, or any combination of a CD20 inhibitor and an inhibitor of CD10, CD22, CD34, CD123, FLT-3, or ROR1 as described herein. In another embodiment, the method includes administering a CD19 inhibitor, e.g., a cell expressing a CD19 CAR, in combination with a CD22 inhibitor, or any combination of a CD22 inhibitor and an inhibitor of CD10, CD20, CD34, CD123, FLT-3, or ROR1 as described herein. In another embodiment, the method includes administering a CD19 inhibitor, e.g., a cell expressing a CD19 CAR, in combination with a CD34 inhibitor, or any combination of a CD34 inhibitor and an inhibitor of CD10, CD20, CD22, CD123, FLT-3, or ROR1 as described herein. In another embodiment, the method includes administering a CD19 inhibitor, e.g., a cell expressing a CD19 CAR in combination with a CD123 inhibitor, or any combination of a CD123 inhibitor and an inhibitor of CD10, CD20, CD34, CD22, FLT-3, or ROR1 as described herein. In another embodiment, the method includes administering a CD19 inhibitor, e.g., a cell expressing a CD19 CAR, in combination with a FLT-3 inhibitor, or any combination of a FLT-3 inhibitor and an inhibitor of CD10, CD20, CD34, CD123, or ROR1 as described herein. In another embodiment, the method includes administering a CD19 inhibitor, e.g., a cell expressing a CD19 CAR, in combination with a ROR1 inhibitor, or any combination of a ROR1 inhibitor and an inhibitor of CD10, CD20, CD34, CD123, or FLT-3, as described herein. In some embodiments, the method comprises administering one, two, three or more B-cell inhibitors (e.g., one or more inhibitors of CD10, CD20, CD22, CD34, CD123, FLT-3, or ROR1, CD79b, CD179b, or CD79a as described herein).

In some embodiments, the methods of treatment described herein further comprise one or both of: determining a level of an immune checkpoint molecule (e.g., PD-L1, PD1, LAG3, or TIM3) in a patient sample; and administering an immune checkpoint inhibitor (e.g., an inhibitor of one or more of PD-L1, PD1, LAG3, and TIM3) to the patient. For example, the method can comprise treating a patient with one or more CAR-expressing cells described herein (e.g., CD19 CAR in combination with a B-cell inhibitor, CD20 CAR, or CD22 CAR) and determining the level of an immune checkpoint molecule in the patient before or after the treatment. In some embodiments, the method comprises administering the immune checkpoint inhibitor to a patient that has elevated levels of the immune checkpoint molecule compared to a reference level, e.g., administering a PD-L1 inhibitor in response to elevated PD-L1 levels, administering a PD1 inhibitor in response to elevated PD1 levels, administering a LAG3 inhibitor in response to elevated LAG3 levels, or administering a TIM3 inhibitor in response to elevated TIM3 levels. In some embodiments, the method comprises administering an immune checkpoint inhibitor to a patient who has received, is receiving, or is about to receive therapy with one or more CAR-expressing cells described herein (e.g., CD19 CAR in combination with a B-cell inhibitor, CD20 CAR, or CD22 CAR), wherein the patient has, or is identified as having, elevated levels of the immune checkpoint molecule compared to a reference level.

Compositions

In some aspects, the present disclosure provides, e.g., a composition comprising: (i) one or more cells that express a CAR molecule that binds CD19, e.g., a CAR molecule that binds CD19 described herein, e.g., a CD19 CAR, and (ii) a B-cell inhibitor, e.g., one or more inhibitors of CD10, CD20, CD22, CD34, CD123, FLT-3, or ROR1. In embodiments, (i) and (ii) are provided separately, and in embodiments, (i) and (ii) are admixed.

In some aspects, the present disclosure provides, e.g., a nucleic acid encoding: (i) a CAR molecule that binds CD19, e.g., a CAR molecule that binds CD19 described herein, e.g., a CD19 CAR, and (ii) one or more B-cell inhibitors, e.g., inhibitors of one or more of CD10, CD20, CD22, CD34, CD123, FLT-3, or ROR1. In some aspects, the present disclosure provides, e.g., a nucleic acid encoding: (i) a CAR molecule that binds CD19, e.g., a CAR molecule that binds CD19 described herein, e.g., a CD19 CAR, and (ii) a CAR molecule that binds a B-cell antigen, e.g., one or more of CD10, CD20, CD22, CD34, CD123, FLT-3, or ROR1. In embodiments, the nucleic acid comprises RNA or DNA.

In some aspects, the present disclosure provides, e.g., a nucleic acid encoding: (i) a CAR molecule that binds CD19, e.g., a CAR molecule that binds CD19 described herein, e.g., a CD19 CAR, and (ii) a CAR molecule that binds a B-cell antigen, e.g., one or more of CD10, CD20, CD22, CD34, CD123, FLT-3, ROR1, CD79b, CD179b, or CD79a. In embodiments, the nucleic acid comprises RNA or DNA. In embodiments, the nucleic acid sequences encoding (i) and (ii) are situated in the same orientation, e.g., transcription of the nucleic acid sequences encoding (i) and (ii) proceeds in the same direction. In embodiments, the nucleic acid sequences encoding (i) and (ii) are situated in different orientations. In embodiments, a single promoter controls expression of the nucleic acid sequences encoding (i) and (ii). In embodiments, a nucleic acid encoding a protease cleavage site (such as a T2A, P2A, E2A, or F2A cleavage site) is situated between the nucleic acid sequences encoding (i) and (ii). In embodiments, the protease cleavage site is placed such that a cell can express a fusion protein comprising (i) and (ii), which protein is subsequently processed into two peptides by proteolytic cleavage. In some embodiments, the nucleic acid sequences encoding (i) is upstream of the nucleic acid sequences encoding (ii), or the nucleic acid sequences encoding (ii) is upstream of the nucleic acid sequences encoding (i). In embodiments, a first promoter controls expression of the nucleic acid sequence encoding (i) and a second promoter controls expression of the nucleic acid sequence encoding (ii). In embodiments, the nucleic acid is a plasmid. In embodiments, the nucleic acid comprises a viral packaging element. In some aspects, the present disclosure provides a cell, e.g., an immune effector cell, comprising the nucleic acid described herein, e.g., a nucleic acid comprising (i) and (ii) as described above. The cell may comprise a protease (e.g., endogenous or exogenous) that cleaves a T2A, P2A, E2A, or F2A cleavage site.

In some aspects, the present disclosure provides, e.g., a composition comprising: (i) a first nucleic acid encoding a CAR molecule that binds CD19, e.g., a CAR molecule that binds CD19 described herein, e.g., a CD19 CAR, and (ii) a second nucleic acid encoding one or more B-cell inhibitors, e.g., inhibitors of one or more of CD10, CD20, CD22, CD34, CD123, FLT-3, or ROR1. In some aspects, the present disclosure provides, e.g., a composition comprising: (i) a first nucleic acid encoding a CAR molecule that binds CD19, e.g., a CAR molecule that binds CD19 described herein, e.g., a CD19 CAR, and (ii) a CAR molecule that binds a B-cell antigen, e.g., one or more of CD10, CD20, CD22, CD34, CD123, FLT-3, or ROR1. In embodiments, the first nucleic acid and second nucleic acid each comprises RNA or DNA.

In some aspects, the present disclosure provides, e.g., a vector comprising a nucleic acid or nucleic acids as described herein. The present disclosure also provides, in certain aspects, a cell comprising a vector or nucleic acid as described herein.

This disclosure also provides, in certain aspects, a composition comprising one or more immune effector cells and: (i) a first nucleic acid encoding, or a first polypeptide comprising, a CAR molecule that binds CD19, e.g., a CAR molecule that binds CD19 described herein, e.g., a CD19 CAR, and (ii) a second nucleic acid encoding, or a second polypeptide comprising, a CAR molecule that binds a B-cell antigen, e.g., one or more of CD10, CD20, CD22, CD34, CD123, FLT-3, ROR1, CD79b, CD179b, or CD79a. In embodiments, the first nucleic acid or first polypeptide and the second nucleic acid or second polypeptide are each contained within, e.g., expressed by, a first immune effector cell. In embodiments, the composition comprises a first immune effector cell containing e.g., expressing the first nucleic acid or first polypeptide and a second immune effector cell containing e.g., expressing the second nucleic acid or second polypeptide. In embodiments, the composition does not comprise a cell containing, e.g., expressing, both of the first nucleic acid or first polypeptide and the second nucleic acid or second polypeptide.

Manufacturing

In certain aspects, the disclosure provides a method of making a cell, comprising transducing an immune effector cell, e.g., a T cell or NK cell, with a vector as described herein, e.g., a vector encoding a CAR. In certain aspects, the disclosure provides a method of making a cell, comprising introducing a nucleic acid as described herein (e.g., a nucleic acid encoding a CAR) into an immune effector cell, e.g., a T cell or NK cell. In certain aspects, the disclosure provides a method of generating a population of RNA-engineered cells comprising introducing an in vitro transcribed RNA or synthetic RNA into a cell, where the RNA comprises a nucleic acid as described herein, e.g., a nucleic acid encoding a CAR.

In some embodiments, the methods of making disclosed herein further comprise contacting the population of cells, (e.g., CD19 CAR-expressing cells, CD20 CAR-expressing cells, CD22 CAR-expressing cells, B-cell inhibitor cells, or both of CD19 CAR-expressing cells and B-cell inhibitor cells), with a nucleic acid encoding a telomerase subunit, e.g., hTERT. The nucleic acid encoding the telomerase subunit can be DNA.

In some embodiments, the method of making disclosed herein further comprises culturing the population of cells, (e.g., CD19 CAR-expressing cells, CD20 CAR-expressing cells, CD22 CAR-expressing cells, B-cell inhibitor cells, or both of CD19 CAR-expressing cells and B-cell inhibitor cells), in serum comprising 2% hAB serum.

Indications

In one embodiment, the disease associated with CD19 expression is selected from a proliferative disease such as a cancer or malignancy or a precancerous condition such as a myelodysplasia, a myelodysplastic syndrome or a preleukemia, or is a non-cancer related indication associated with expression of CD19. In one embodiment, the disease is a solid or a liquid tumor. In one embodiment, the cancer is a pancreatic cancer. In one embodiment, the disease is a hematologic cancer. In one embodiment, the hematologic cancer is a leukemia. In one embodiment, the cancer is selected from the group consisting of one or more acute leukemias including but not limited to B-cell acute lymphoid leukemia (BALL), T-cell acute lymphoid leukemia (TALL), small lymphocytic leukemia (SLL), acute lymphoid leukemia (ALL) (e.g., relapsing and refractory ALL); one or more chronic leukemias including but not limited to chronic myelogenous leukemia (CML), and chronic lymphocytic leukemia (CLL). Additional hematologic cancers or conditions include, but are not limited to mantle cell lymphoma (MCL), B cell prolymphocytic leukemia, blastic plasmacytoid dendritic cell neoplasm, Burkitt's lymphoma, diffuse large B cell lymphoma, follicular lymphoma, hairy cell leukemia, small cell- or a large cell-follicular lymphoma, malignant lymphoproliferative conditions, MALT lymphoma, Marginal zone lymphoma, multiple myeloma, myelodysplasia and myelodysplastic syndrome, non-Hodgkin lymphoma, Hodgkin lymphoma, plasmablastic lymphoma, plasmacytoid dendritic cell neoplasm, Waldenstrom macroglobulinemia, and "preleukemia." Preleukemia encompasses a diverse collection of hematological conditions united by ineffective production (or dysplasia) of myeloid blood cells. In embodiments, a disease associated with CD19 expression include, but not limited to atypical and/or non-classical cancers, malignancies, precancerous conditions or proliferative diseases expressing CD19; and any combination thereof.

In one embodiment, the disease associated with expression of CD19 is a lymphoma, e.g., MCL or Hodgkin lymphoma. In one embodiment, the disease associated with expression of CD19 is leukemia, e.g., SLL, CLL and/or ALL.

In one embodiment, the disease associated with a tumor antigen, e.g., a tumor antigen described herein, is selected from a proliferative disease such as a cancer or malignancy or a precancerous condition such as a myelodysplasia, a myelodysplastic syndrome or a preleukemia, or is a non-cancer related indication associated with expression of a tumor antigen described herein. In an embodiment, the disease associated with a tumor antigen described herein is a solid tumor, e.g., a solid tumor described herein, e.g., prostatic, colorectal, pancreatic, cervical, gastric, ovarian, head, or lung cancer.

In an embodiment, the cancer is chosen from AML, ALL, B-ALL, T-ALL, B-cell prolymphocytic leukemia, chronic lymphocytic leukemia, CML, hairy cell leukemia, Hodgkin lymphoma, mast cell disorder, myelodysplastic syndrome, myeloproliferative neoplasm, plasma cell myeloma, plasmacytoid dendritic cell neoplasm, or a combination thereof.

In an embodiment, the subject (e.g., a subject to be treated with a CD19 CAR, optionally in combination with a second agent such as a PD1 inhibitor or PD-L1 inhibitor) has, or is identified as having, at least 5%, 6%, 7%, 8%, 9%, 10%, 20%, 30%, 40%, 50%, 60%, 70%, 80%, or 90% of cancer cells, e.g., DLBCL cells, which are CD3+/PD1+.

In an embodiment, the subject has relapsed or is identified as having relapsed after treatment with the one or more cells that express a CAR molecule that binds CD19, e.g., a CD19 CAR. In an embodiment, the subject has relapsed or is identified as having relapsed based on one or more of reappearance of blasts in the blood, bone marrow (>5%), or any extramedullary site, after a complete response. In an embodiment, the subject has relapsed or is identified as having relapsed based on detection of CD19− blasts above a predetermined threshold, e.g., over 1%, 2%, 3%, 4%, 5%, or 10%.

Car Therapies

In certain embodiments, the method of treatment comprises a CAR therapy, e.g., administration of one or more cells that express one or more CAR molecules. A cell expressing one or more CAR molecules can be an immune effector cell, e.g., a T cell or NK cell. In an embodiment, the subject is a human.

In one embodiment, the cell expressing the CAR molecule comprises a vector that includes a nucleic acid sequence encoding the CAR molecule. In one embodiment, the vector is selected from the group consisting of a DNA, an RNA, a plasmid, a lentivirus vector, adenoviral vector, or a retrovirus vector. In one embodiment, the vector is a lentivirus vector. In one embodiment, the vector further comprises a promoter. In one embodiment, the promoter is an EF-1 promoter. In one embodiment, the EF-1 promoter comprises a sequence of SEQ ID NO: 100. In one embodiment, the vector is an in vitro transcribed vector, e.g., a vector that transcribes RNA of a nucleic acid molecule described herein. In one embodiment, the nucleic acid sequence in the in vitro vector further comprises a poly(A) tail, e.g., a poly A tail described herein, e.g., comprising about 150 adenosine bases. In one embodiment, the nucleic acid sequence in the in vitro vector further comprises a 3'UTR, e.g., a 3' UTR described herein, e.g., comprising at least one repeat of a 3'UTR derived from human beta-globulin. In one embodiment, the nucleic acid sequence in the in vitro vector further comprises promoter. In one embodiment, the nucleic acid sequence comprises a T2A sequence.

In one embodiment, the cell expressing the CAR molecule is a cell described herein, e.g., a human T cell or a human NK cell, e.g., a human T cell described herein or a human NK cell described herein. In one embodiment, the human T cell is a CD8+ T cell. In one embodiment, the human T cell is a CD4+ T cell. In one embodiment, the human T cell is a CD4+/CD8+ T cell. In one embodiment the human T cell is a mixture of CD8+ and CD4+ T cells. In one embodiment, the cell is an autologous T cell. In one embodiment, the cell is an allogeneic T cell. In one embodiment, the cell is a T cell and the T cell is diacylglycerol kinase (DGK) deficient. In one embodiment, the cell is a T cell and the T cell is Ikaros deficient. In one embodiment, the cell is a T cell and the T cell is both DGK and Ikaros deficient.

In another embodiment, the cell expressing the CAR molecule, e.g., as described herein, can further express another agent, e.g., an agent which enhances the activity of a CAR-expressing cell.

In one embodiment, the method includes administering a cell expressing the CAR molecule, as described herein, in combination with an agent which enhances the activity of a CAR-expressing cell, wherein the agent is a cytokine, e.g., IL-7, IL-15, IL-21, or a combination thereof. The cytokine can be delivered in combination with, e.g., simultaneously or shortly after, administration of the CAR-expressing cell. Alternatively, the cytokine can be delivered after a prolonged period of time after administration of the CAR-expressing cell, e.g., after assessment of the subject's response to the CAR-expressing cell.

For example, in one embodiment, the agent that enhances the activity of a CAR-expressing cell can be an agent which inhibits an immune inhibitory molecule. Examples of immune inhibitory molecules include PD1, PD-L1, CTLA4, TIM3, CEACAM (e.g., CEACAM-1, CEACAM-3 and/or CEACAM-5), LAG3, VISTA, BTLA, TIGIT, LAIR1, CD160, 2B4 and TGFR beta. In one embodiment, the agent that inhibits an immune inhibitory molecule comprises a first polypeptide, e.g., an inhibitory molecule, associated with a second polypeptide that provides a positive signal to the cell, e.g., an intracellular signaling domain described herein. In one embodiment, the agent comprises a first polypeptide, e.g., of an immune inhibitory molecule such as PD1, PD-L1, CTLA4, TIM3, CEACAM (e.g., CEACAM-1, CEACAM-3 and/or CEACAM-5), LAG3, VISTA, BTLA, TIGIT, LAIR1, CD160, 2B4 or TGFR beta, or a fragment of any of these (e.g., at least a portion of the extracellular domain of any of these), and a second polypeptide which is an intracellular signaling domain described herein (e.g., comprising a costimulatory domain (e.g., 41BB, CD27 or CD28, e.g., as described herein) and/or a primary signaling domain (e.g., a CD3 zeta signaling domain described herein). In one embodiment, the agent comprises a first polypeptide of PD1 or a fragment thereof (e.g., at least a portion of the extracellular domain of PD1), and a second polypeptide of an intracellular signaling domain described herein (e.g., a CD28 signaling domain described herein and/or a CD3 zeta signaling domain described herein).

In one embodiment, lymphocyte infusion, for example allogeneic lymphocyte infusion, is used in the treatment of the cancer, wherein the lymphocyte infusion comprises at least one CD19 CAR-expressing cell described herein and optionally at least one cell expressing a CAR directed against a B-cell antigen. In one embodiment, autologous lymphocyte infusion is used in the treatment of the cancer, wherein the autologous lymphocyte infusion comprises at least one CD19-expressing cell and optionally at least one cell expressing a CAR directed against a B-cell antigen.

In one embodiment, the CAR expressing cell, e.g., T cell, is administered to a subject that has received a previous stem cell transplantation, e.g., autologous stem cell transplantation, or a subject that has received a previous dose of melphalan.

In one embodiment, the cell expressing the CAR molecule, e.g., a CAR molecule described herein, is administered in combination with an agent that ameliorates one or more side effect associated with administration of a cell expressing a CAR molecule or with administration of the B-cell inhibitor, e.g., an agent described herein.

In one embodiment, the cell expressing the CAR molecule, e.g., a CD19 CAR molecule described herein, and the B-cell inhibitor are administered in combination with an additional agent that treats the disease associated with CD19, e.g., an additional agent described herein.

In one embodiment, the cells expressing a CAR molecule, e.g., a CAR molecule described herein, are administered at a dose and/or dosing schedule described herein.

In one embodiment, the CAR molecule is introduced into T cells, e.g., using in vitro transcription, and the subject (e.g., human) receives an initial administration of cells comprising a CAR molecule, and one or more subsequent administrations of cells comprising a CAR molecule, wherein the one or more subsequent administrations are administered less than 15 days, e.g., 14, 13, 12, 11, 10, 9, 8, 7, 6, 5, 4, 3, or 2 days after the previous administration. In one embodiment, more than one administration of cells comprising a CAR molecule are administered to the subject (e.g., human) per week, e.g., 2, 3, or 4 administrations of cells comprising a CAR molecule are administered per week. In one embodiment, the subject (e.g., human subject) receives more than one administration of cells comprising a CAR molecule per week (e.g., 2, 3 or 4 administrations per week) (also referred to herein as a cycle), followed by a week of no administration of cells comprising a CAR molecule, and then one or more additional administration of cells comprising a CAR molecule (e.g., more than one administration of the cells comprising a CAR molecule per week) is administered to the subject. In another embodiment, the subject (e.g., human subject) receives more than one cycle of cells comprising a CAR molecule, and the time between each cycle is less than 10, 9, 8, 7, 6, 5, 4, or 3 days. In one embodiment, the cells comprising a CAR molecule are administered every other day for 3 administrations per week. In one embodiment, the cells comprising a CAR molecule are administered for at least two, three, four, five, six, seven, eight or more weeks.

In one embodiment, the therapy described herein (e.g., a CD20 CAR therapy, a CD22 CAR therapy, or a combination of the B-cell inhibitor and the cells expressing a CD19 CAR molecule, e.g., a CD19 CAR molecule described herein) are administered as a first line treatment for the disease, e.g., the cancer, e.g., the cancer described herein. In another embodiment, the therapy described herein (e.g., a CD20 CAR therapy, a CD22 CAR therapy, or a combination of the B-cell inhibitor and the cells expressing a CD19 CAR molecule, e.g., a CD19 CAR molecule described herein) are administered as a second, third, fourth line treatment for the disease, e.g., the cancer, e.g., the cancer described herein.

In one embodiment, a population of cells described herein is administered. In some embodiments the population of cells is isolated or purified.

In one embodiment, the method includes administering a population of cells, a plurality of which comprise a CAR molecule described herein. In some embodiments, the population of CAR-expressing cells comprises a mixture of cells expressing different CARs. For example, in one embodiment, the population of CAR-expressing cells can include a first cell expressing a CAR having an anti-CD19 binding domain described herein, and a second cell expressing a CAR having a different B-cell antigen binding domain. In embodiments, the first and second cell populations are T cells. In embodiments, the first and second populations of T cells are the same isotype, e.g., are both CD4+ T cells, or are both CD8+ T cells. In other embodiments, the first and second populations of T cells are different isotypes, e.g., the first population comprises CD4+ T cells and the second population comprises CD8+ T cells. In embodiments, the first and second populations of T cells are cell types described in WO2012/129514, which is herein incorporated by reference in its entirety. As another example, a population of cells can comprise a single cell type that expresses both a CAR having an anti-CD19 binding domain described herein and a CAR having a different B-cell antigen binding domain. As another example, a population of cells can comprise a single cell type that expresses a CAR having two or more (e.g., 2, 3, 4, or 5) B-cell antigen binding domains, e.g., is a bispecific CAR, e.g., as described herein. As another example, the population of CAR-expressing cells can include a first cell expressing a CAR that includes an anti-CD19 binding domain, e.g., as described herein, and a second cell expressing a CAR that includes an antigen binding domain to a target other than CD19 (e.g., CD10, CD20, CD22, CD34, CD123, FLT-3, ROR1, CD79b, CD179b, CD79a, or mesothelin). In one embodiment, the population of CAR-expressing cells includes, e.g., a first cell expressing a CAR that includes a primary intracellular signaling domain, and a second cell expressing a CAR that includes a secondary signaling domain. In one embodiment, the population of CAR-expressing cells includes, e.g., a first cell expressing a CAR that includes a first secondary signaling domain, and a second cell expressing a CAR that includes a secondary signaling domain different from the first secondary signaling domain.

As an example, when the first B-cell inhibitor is a CD19 CAR-expressing cell and the second B-cell inhibitor is a CD10 CAR-expressing cell, the first CAR and second CAR may be expressed by the same cell type or different types. For instance, in some embodiments, the cell expressing a CD19 CAR is a CD4+ T cell and the cell expressing a CD10 CAR is a CD8+ T cell, or the cell expressing a CD19 CAR is a CD8+ T cell and the cell expressing a CD10 CAR is a CD4+ T cell. In other embodiments, the cell expressing a CD19 CAR is a T cell and the cell expressing a CD10 CAR is a NK cell, or the cell expressing a CD19 CAR is a NK cell and the cell expressing a CD10 CAR is a T cell. In other embodiments, the cell expressing a CD19 CAR and the cell expressing a CD10 CAR are both NK cells or are both T cells, e.g., are both CD4+ T cells, or are both CD8+ T cells. In yet other embodiments, a single cell expresses the CD19 CAR and CD10 CAR, and this cell is, e.g., a NK cell or a T cell such as a CD4+ T cell or CD8+ T cell. The first CAR and second CAR can comprise the same or different intracellular signaling domains. For instance, in some embodiments the CD19 CAR comprises a CD3 zeta signaling domain and the CD10 CAR comprises a costimulatory domain, e.g., a 41BB, CD27 or CD28 costimulatory domain, while in some embodiments, the CD19 CAR comprises a costimulatory domain, e.g., a 41BB, CD27 or CD28 costimulatory domain and the CD10 CAR comprises a CD3 zeta signaling domain. In other embodiments, each of the CD19 CAR and the CD10 CAR comprises the same type of primary signaling domain, e.g., a CD3 zeta signaling domain, but the CD19 CAR and the CD10 CAR comprise different costimulatory domains, e.g., (1) the CD19 CAR comprises a 41BB costimulatory domain and the CD10 CAR comprises a different costimulatory domain e.g., a CD27 costimulatory domain, (2) the CD19 CAR comprises a CD27 costimulatory domain and the CD10 CAR comprises a different costimulatory domain e.g., a 41BB costimulatory domain, (3) the CD19 CAR comprises a 41BB costimulatory domain and the CD10 CAR comprises a CD28 costimulatory domain, (4) the CD19 CAR comprises a CD28 costimulatory domain and the CD10 CAR comprises a different costimulatory domain e.g., a 41BB costimulatory domain, (5) the CD19 CAR comprises a CD27 costimulatory domain and the CD10 CAR comprises a CD28 costimulatory domain, or (6) the CD19 CAR comprises a CD28 costimulatory domain and the CD10 CAR comprises a CD27 costimulatory domain. In another embodiment, a cell comprises a CAR that comprises both a CD19 antigen-binding domain and a CD10 antigen-binding domain, e.g., a bispecific antibody.

As another example, when the first B-cell inhibitor is a CD19 CAR-expressing cell and the second B-cell inhibitor is a CD20 CAR-expressing cell, the first CAR and second CAR may be expressed by the same cell type or different types. For instance, in some embodiments, the cell expressing a CD19 CAR is a CD4+ T cell and the cell expressing a CD20 CAR is a CD8+ T cell, or the cell expressing a CD19 CAR is a CD8+ T cell and the cell expressing a CD20 CAR is a CD4+ T cell. In other embodiments, the cell expressing a CD19 CAR is a T cell and the cell expressing a CD20 CAR is a NK cell, or the cell expressing a CD19 CAR is a NK cell and the cell expressing a CD20 CAR is a T cell. In other embodiments, the cell expressing a CD19 CAR and the cell expressing a CD20 CAR are both NK cells or are both T cells, e.g., are both CD4+ T cells, or are both CD8+ T cells. In yet other embodiments, a single cell expresses the CD19 CAR and CD20 CAR, and this cell is, e.g., a NK cell or a T cell such as a CD4+ T cell or CD8+ T cell. The first CAR and second CAR can comprise the same or different intracellular signaling domains. For instance, in some embodiments the CD19 CAR comprises a CD3 zeta signaling domain and the CD20 CAR comprises a costimulatory domain, e.g., a 41BB, CD27 or CD28 costimulatory domain, while in some embodiments, the CD19 CAR comprises a costimulatory domain, e.g., a 41BB, CD27 or CD28 costimulatory domain and the CD20 CAR comprises a CD3 zeta signaling domain. In other embodiments, each of the CD19 CAR and the CD20 CAR comprises the same type of primary signaling domain, e.g., a CD3 zeta signaling domain, but the CD19 CAR and the CD20 CAR comprise different costimulatory domains, e.g., (1) the CD19 CAR comprises a 41BB costimulatory domain and the CD20 CAR comprises a different costimulatory domain e.g., a CD27 costimulatory domain, (2) the CD19 CAR comprises a CD27 costimulatory domain and the CD20 CAR comprises a different costimulatory domain e.g., a 41BB costimulatory domain, (3) the CD19 CAR comprises a 41BB costimulatory domain and the CD20 CAR comprises a CD28 costimulatory domain, (4) the CD19 CAR comprises a CD28 costimulatory domain and the CD20 CAR comprises a different costimulatory domain e.g., a 41BB costimulatory domain, (5) the CD19 CAR comprises a CD27 costimulatory domain and the CD20 CAR comprises a CD28 costimulatory domain, or (6) the CD19 CAR comprises a CD28 costimulatory domain and the CD20 CAR comprises a CD27 costimulatory domain. In another embodiment, a cell comprises a CAR that comprises both a CD19 antigen-binding domain and a CD20 antigen-binding domain, e.g., a bispecific antibody.

As another example, when the first B-cell inhibitor is a CD19 CAR-expressing cell and the second B-cell inhibitor is a CD22 CAR-expressing cell, the first CAR and second CAR may be expressed by the same cell type or different types. For instance, in some embodiments, the cell expressing a CD19 CAR is a CD4+ T cell and the cell expressing a CD22 CAR is a CD8+ T cell, or the cell expressing a CD19 CAR is a CD8+ T cell and the cell expressing a CD22 CAR is a CD4+ T cell. In other embodiments, the cell expressing a CD19 CAR is a T cell and the cell expressing a CD22 CAR is a NK cell, or the cell expressing a CD19 CAR is a NK cell and the cell expressing a CD22 CAR is a T cell. In other embodiments, the cell expressing a CD19 CAR and the cell expressing a CD22 CAR are both NK cells or are both T cells, e.g., are both CD4+ T cells, or are both CD8+ T cells. In yet other embodiments, a single cell expresses the CD19 CAR and CD22 CAR, and this cell is, e.g., a NK cell or a T cell such as a CD4+ T cell or CD8+ T cell. The first CAR and second CAR can comprise the same or different intracellular signaling domains. For instance, in some embodiments the CD19 CAR comprises a CD3 zeta signaling domain and the CD22 CAR comprises a costimulatory domain, e.g., a 41BB, CD27 or CD28 costimulatory domain, while in some embodiments, the CD19 CAR comprises a costimulatory domain, e.g., a 41BB, CD27 or CD28 costimulatory domain and the CD22 CAR comprises a CD3 zeta signaling domain. In other embodiments, each of the CD19 CAR and the CD22 CAR comprises the same type of primary signaling domain, e.g., a CD3 zeta signaling domain, but the CD19 CAR and the CD22 CAR comprise different costimulatory domains, e.g., (1) the CD19 CAR comprises a 41BB costimulatory domain and the CD22 CAR comprises a different costimulatory domain e.g., a CD27 costimulatory domain, (2) the CD19 CAR comprises a CD27 costimulatory domain and the CD22 CAR comprises a different costimulatory domain e.g., a 41BB costimulatory domain, (3) the CD19 CAR comprises a 41BB costimulatory domain and the CD22 CAR comprises a CD28 costimulatory domain, (4) the CD19 CAR comprises a CD28 costimulatory domain and the CD22 CAR comprises a different costimulatory domain e.g., a 41BB costimulatory domain, (5) the CD19 CAR comprises a CD27 costimulatory domain and the CD22 CAR comprises a CD28 costimulatory domain, or (6) the CD19 CAR comprises a CD28 costimulatory domain and the CD22 CAR comprises a CD27 costimulatory domain. In another embodiment, a cell comprises a CAR that comprises both a CD19 antigen-binding domain and a CD22 antigen-binding domain, e.g., a bispecific antibody.

As another example, when the first B-cell inhibitor is a CD19 CAR-expressing cell and the second B-cell inhibitor is a CD34 CAR-expressing cell, the first CAR and second CAR may be expressed by the same cell type or different types. For instance, in some embodiments, the cell expressing a CD19 CAR is a CD4+ T cell and the cell expressing a CD34 CAR is a CD8+ T cell, or the cell expressing a CD19 CAR is a CD8+ T cell and the cell expressing a CD34 CAR is a CD4+ T cell. In other embodiments, the cell expressing a CD19 CAR is a T cell and the cell expressing a CD34 CAR is a NK cell, or the cell expressing a CD19 CAR is a NK cell and the cell expressing a CD34 CAR is a T cell. In other embodiments, the cell expressing a CD19 CAR and the cell expressing a CD34 CAR are both NK cells or are both T cells, e.g., are both CD4+ T cells, or are both CD8+ T cells. In yet other embodiments, a single cell expresses the CD19 CAR and CD34 CAR, and this cell is, e.g., a NK cell or a T cell such as a CD4+ T cell or CD8+ T cell. The first CAR and second CAR can comprise the same or different intracellular signaling domains. For instance, in some embodiments the CD19 CAR comprises a CD3 zeta signaling domain and the CD34 CAR comprises a costimulatory domain, e.g., a 41BB, CD27 or CD28 costimulatory domain, while in some embodiments, the CD19 CAR comprises a costimulatory domain, e.g., a 41BB, CD27 or CD28 costimulatory domain and the CD34 CAR comprises a CD3 zeta signaling domain. In other embodiments, each of the CD19 CAR and the CD34 CAR comprises the same type of primary signaling domain, e.g., a CD3 zeta signaling domain, but the CD19 CAR and the CD34 CAR comprise different costimulatory domains, e.g., (1) the CD19 CAR comprises a 41BB costimulatory domain and the CD34 CAR comprises a different costimulatory domain e.g., a CD27 costimulatory domain, (2) the CD19 CAR comprises a CD27 costimulatory domain and the CD34 CAR comprises a different costimulatory domain e.g., a 41BB costimulatory domain, (3) the CD19 CAR comprises a 41BB costimulatory domain and the CD34 CAR comprises a CD28 costimulatory domain, (4) the CD19 CAR comprises a CD28 costimulatory domain and the CD34 CAR comprises a different costimulatory domain e.g., a 41BB costimulatory domain, (5) the CD19 CAR comprises a CD27 costimulatory domain and the CD34 CAR comprises a CD28 costimulatory domain, or (6) the CD19 CAR comprises a CD28 costimulatory domain and the CD34 CAR comprises a CD27 costimulatory domain. In another embodiment, a cell comprises a CAR that comprises both a CD19 antigen-binding domain and a CD34 antigen-binding domain, e.g., a bispecific antibody.

As another example, when the first B-cell inhibitor is a CD19 CAR-expressing cell and the second B-cell inhibitor is a CD123 CAR-expressing cell, the first CAR and second CAR may be expressed by the same cell type or different types. For instance, in some embodiments, the cell expressing a CD19 CAR is a CD4+ T cell and the cell expressing a CD123 CAR is a CD8+ T cell, or the cell expressing a CD19 CAR is a CD8+ T cell and the cell expressing a CD123 CAR is a CD4+ T cell. In other embodiments, the cell expressing a CD19 CAR is a T cell and the cell expressing a CD123 CAR is a NK cell, or the cell expressing a CD19 CAR is a NK cell and the cell expressing a CD123 CAR is a T cell. In other embodiments, the cell expressing a CD19 CAR and the cell expressing a CD123 CAR are both NK cells or are both T cells, e.g., are both CD4+ T cells, or are both CD8+ T cells. In yet other embodiments, a single cell expresses the CD19 CAR and CD123 CAR, and this cell is, e.g., a NK cell or a T cell such as a CD4+ T cell or CD8+ T cell. The first CAR and second CAR can comprise the same or different intracellular signaling domains. For instance, in some embodiments the CD19 CAR comprises a CD3 zeta signaling domain and the CD123 CAR comprises a costimulatory domain, e.g., a 41BB, CD27 or CD28 costimulatory domain, while in some embodiments, the CD19 CAR comprises a costimulatory domain, e.g., a 41BB, CD27 or CD28 costimulatory domain and the CD123 CAR comprises a CD3 zeta signaling domain. In other embodiments, each of the CD19 CAR and the CD123 CAR comprises the same type of primary signaling domain, e.g., a CD3 zeta signaling domain, but the CD19 CAR and the CD123 CAR comprise different costimulatory domains, e.g., (1) the CD19 CAR comprises a 41BB costimulatory domain and the CD123 CAR comprises a different costimulatory domain e.g., a CD27 costimulatory domain, (2) the CD19 CAR comprises a CD27 costimulatory domain and the CD123 CAR comprises a different costimulatory domain e.g., a 41BB costimulatory domain, (3) the CD19 CAR comprises a 41BB costimulatory domain and the CD123 CAR comprises a CD28 costimulatory domain, (4) the CD19 CAR comprises a CD28 costimulatory domain and the CD123 CAR comprises a different costimulatory domain e.g., a 41BB costimulatory domain, (5) the CD19 CAR comprises a CD27 costimulatory domain and the CD123 CAR comprises a CD28 costimulatory domain, or (6) the CD19 CAR comprises a CD28 costimulatory domain and the CD123 CAR comprises a CD27 costimulatory domain. In another embodiment, a cell comprises a CAR that comprises both a CD19 antigen-binding domain and a CD123 antigen-binding domain, e.g., a bispecific antibody.

As another example, when the first B-cell inhibitor is a CD19 CAR-expressing cell and the second B-cell inhibitor is a FLT-3 CAR-expressing cell, the first CAR and second CAR may be expressed by the same cell type or different types. For instance, in some embodiments, the cell expressing a CD19 CAR is a CD4+ T cell and the cell expressing a FLT-3 CAR is a CD8+ T cell, or the cell expressing a CD19 CAR is a CD8+ T cell and the cell expressing a FLT-3 CAR is a CD4+ T cell. In other embodiments, the cell expressing a CD19 CAR is a T cell and the cell expressing a FLT-3 CAR is a NK cell, or the cell expressing a CD19 CAR is a NK cell and the cell expressing a FLT-3 CAR is a T cell. In other embodiments, the cell expressing a CD19 CAR and the cell expressing a FLT-3 CAR are both NK cells or are both T cells, e.g., are both CD4+ T cells, or are both CD8+ T cells. In yet other embodiments, a single cell expresses the CD19 CAR and FLT-3 CAR, and this cell is, e.g., a NK cell or a T cell such as a CD4+ T cell or CD8+ T cell. The first CAR and second CAR can comprise the same or different intracellular signaling domains. For instance, in some embodiments the CD19 CAR comprises a CD3 zeta signaling domain and the FLT-3 CAR comprises a costimulatory domain, e.g., a 41BB, CD27 or CD28 costimulatory domain, while in some embodiments, the CD19 CAR comprises a costimulatory domain, e.g., a 41BB, CD27 or CD28 costimulatory domain and the FLT-3 CAR comprises a CD3 zeta signaling domain. In other embodiments, each of the CD19 CAR and the FLT-3 CAR comprises the same type of primary signaling domain, e.g., a CD3 zeta signaling domain, but the CD19 CAR and the FLT-3 CAR comprise different costimulatory domains, e.g., (1) the CD19 CAR comprises a 41BB costimulatory domain and the FLT-3 CAR comprises a different costimulatory domain e.g., a CD27 costimulatory domain, (2) the CD19 CAR comprises a CD27 costimulatory domain and the FLT-3 CAR comprises a different costimulatory domain e.g., a 41BB costimulatory domain, (3) the CD19 CAR comprises a 41BB costimulatory domain and the FLT-3 CAR comprises a CD28 costimulatory domain, (4) the CD19 CAR comprises a CD28 costimulatory domain and the FLT-3 CAR comprises a different costimulatory domain e.g., a 41BB costimulatory domain, (5) the CD19 CAR comprises a CD27 costimulatory domain and the FLT-3 CAR comprises a CD28 costimulatory domain, or (6) the CD19 CAR comprises a CD28 costimulatory domain and the FLT-3 CAR comprises a CD27 costimulatory domain. In another embodiment, a cell comprises a CAR that comprises both a CD19 antigen-binding domain and a FLT-3 antigen-binding domain, e.g., a bispecific antibody.

As another example, when the first B-cell inhibitor is a CD19 CAR-expressing cell and the second B-cell inhibitor is a ROR1 CAR-expressing cell, the first CAR and second CAR may be expressed by the same cell type or different types. For instance, in some embodiments, the cell expressing a CD19 CAR is a CD4+ T cell and the cell expressing a ROR1 CAR is a CD8+ T cell, or the cell expressing a CD19 CAR is a CD8+ T cell and the cell expressing a ROR1 CAR is a CD4+ T cell. In other embodiments, the cell expressing a CD19 CAR is a T cell and the cell expressing a ROR1 CAR is a NK cell, or the cell expressing a CD19 CAR is a NK cell and the cell expressing a ROR1 CAR is a T cell. In other embodiments, the cell expressing a CD19 CAR and the cell expressing a ROR1 CAR are both NK cells or are both T cells, e.g., are both CD4+ T cells, or are both CD8+ T cells. In yet other embodiments, a single cell expresses the CD19 CAR and ROR1 CAR, and this cell is, e.g., a NK cell or a T cell such as a CD4+ T cell or CD8+ T cell. The first CAR and second CAR can comprise the same or different intracellular signaling domains. For instance, in some embodiments the CD19 CAR comprises a CD3 zeta signaling domain and the ROR1 CAR comprises a costimulatory domain, e.g., a 41BB, CD27 or CD28 costimulatory domain, while in some embodiments, the CD19 CAR comprises a costimulatory domain, e.g., a 41BB, CD27 or CD28 costimulatory domain and the ROR1 CAR comprises a CD3 zeta signaling domain. In other embodiments, each of the CD19 CAR and the ROR1 CAR comprises the same type of primary signaling domain, e.g., a CD3 zeta signaling domain, but the CD19 CAR and the ROR1 CAR comprise different costimulatory domains, e.g., (1) the CD19 CAR comprises a 41BB costimulatory domain and the ROR1 CAR comprises a different costimulatory domain e.g., a CD27 costimulatory domain, (2) the CD19 CAR comprises a CD27 costimulatory domain and the ROR1 CAR comprises a different costimulatory domain e.g., a 41BB costimulatory domain, (3) the CD19 CAR comprises a 41BB costimulatory domain and the ROR1 CAR comprises a CD28 costimulatory domain, (4) the CD19 CAR comprises a CD28 costimulatory domain and the ROR1 CAR comprises a different costimulatory domain e.g., a 41BB costimulatory domain, (5) the CD19 CAR comprises a CD27 costimulatory domain and the ROR1 CAR comprises a CD28 costimulatory domain, or (6) the CD19 CAR comprises a CD28 costimulatory domain and the ROR1 CAR comprises a CD27 costimulatory domain. In another embodiment, a cell comprises a CAR that comprises both a CD19 antigen-binding domain and a ROR1 antigen-binding domain, e.g., a bispecific antibody.

More generally, when the first B-cell inhibitor comprises a CD19 CAR and there is a second B-cell inhibitor e.g., which comprises a second CAR, the first CAR and the second B-cell inhibitor may be expressed by the same cell type or different types. For instance, in some embodiments, the cell expressing a CD19 CAR is a CD4+ T cell and the cell expressing the second B-cell inhibitor is a CD8+ T cell, or the cell expressing a CD19 CAR is a CD8+ T cell and the cell expressing the second B-cell inhibitor is a CD4+ T cell. In other embodiments, the cell expressing a CD19 CAR is a T cell and the cell expressing a second B-cell inhibitor is a NK cell, or the cell expressing a CD19 CAR is a NK cell and the cell expressing a second B-cell inhibitor is a T cell. In other embodiments, the cell expressing a CD19 CAR and the cell expressing a second B-cell inhibitor are both NK cells or are both T cells, e.g., are both CD4+ T cells, or are both CD8+ T cells. In yet other embodiments, a single cell expresses the CD19 CAR and the second B-cell inhibitor, and this cell is, e.g., a NK cell or a T cell such as a CD4+ T cell or CD8+ T cell. The first CAR and second CAR can comprise the same or different intracellular signaling domains. For instance, in some embodiments the CD19 CAR comprises a CD3 zeta signaling domain and second B-cell inhibitor (or CAR), comprises a costimulatory domain, e.g., a 41BB, CD27 or CD28 costimulatory domain, while in some embodiments, the CD19 CAR comprises a costimulatory domain, e.g., a 41BB, CD27 or CD28 costimulatory domain and the second B-cell inhibitor (or second CAR), comprises a CD3 zeta signaling domain. In other embodiments, each of the CD19 CAR and the second B-cell inhibitor (or second CAR), comprises the same type of primary signaling domain, e.g., a CD3 zeta signaling domain, but the CD19 CAR and the second B-cell inhibitor comprise different costimulatory domains, e.g., (1) the CD19 CAR comprises a 41BB costimulatory domain and the second B-cell inhibitor (or second CAR), comprises a different costimulatory domain e.g., a CD27 costimulatory domain, (2) the CD19 CAR comprises a CD27 costimulatory domain and the second B-cell inhibitor (or second CAR) comprises a different costimulatory domain e.g., a 41BB costimulatory domain, (3) the CD19 CAR comprises a 41BB costimulatory domain and the second B-cell inhibitor (or second CAR), comprises a CD28 costimulatory domain, (4) the CD19 CAR comprises a CD28 costimulatory domain and the second B-cell inhibitor (or second CAR) comprises a different costimulatory domain e.g., a 41BB costimulatory domain, (5) the CD19 CAR comprises a CD27 costimulatory domain and the second B-cell inhibitor (or second CAR), comprises a CD28 costimulatory domain, or (6) the CD19 CAR comprises a CD28 costimulatory domain and the second B-cell inhibitor (or second CAR), comprises a CD27 costimulatory domain. In another embodiment, a cell comprises a CAR that comprises both a CD19 antigen-binding domain and an antigen-binding domain directed to a second antigen, e.g., a bispecific antibody.

In one embodiment, the 4-1BB costimulatory domain comprises a sequence of SEQ ID NO: 16. In one embodiment, the 4-1BB costimulatory domain comprises an amino acid sequence having at least one, two or three modifications (e.g., substitutions) but not more than 20, 10 or 5 modifications (e.g., substitutions) of an amino acid sequence of SEQ ID NO: 16, or a sequence with 95-99% identity to an amino acid sequence of SEQ ID NO:16. In one embodiment, the 4-1BB costimulatory domain is encoded by a nucleic acid sequence of SEQ ID NO:60, or a sequence with 95-99% identity thereof.

In one embodiment, the CD27 costimulatory domain comprises a sequence of SEQ ID NO: 16. In one embodiment, the CD27 costimulatory domain comprises an amino acid sequence having at least one, two or three modifications (e.g., substitutions) but not more than 20, 10 or 5 modifications (e.g., substitutions) of an amino acid sequence of SEQ ID NO: 16, or a sequence with 95-99% identity to an amino acid sequence of SEQ ID NO:16. In one embodiment, the CD27 costimulatory domain is encoded by a nucleic acid sequence of SEQ ID NO:17, or a sequence with 95-99% identity thereof.

In one embodiment, the CD28 costimulatory domain comprises a sequence of SEQ ID NO: 1317. In one embodiment, the CD28 costimulatory domain comprises an amino acid sequence having at least one, two or three modifications (e.g., substitutions) but not more than 20, 10 or 5 modifications (e.g., substitutions) of an amino acid sequence of SEQ ID NO: 1317, or a sequence with 95-99% identity to an amino acid sequence of SEQ ID NO:1317. In one embodiment, the CD28 costimulatory domain is encoded by a nucleic acid sequence of SEQ ID NO:1318, or a sequence with 95-99% identity thereof.

In one embodiment, the wild-type ICOS costimulatory domain comprises a sequence of SEQ ID NO: 1319. In one embodiment, the wild-type ICOS costimulatory domain comprises an amino acid sequence having at least one, two or three modifications (e.g., substitutions) but not more than 20, 10 or 5 modifications (e.g., substitutions) of an amino acid sequence of SEQ ID NO: 1319, or a sequence with 95-99% identity to an amino acid sequence of SEQ ID NO: 1319. In one embodiment, the wild-type ICOS costimulatory domain is encoded by a nucleic acid sequence of SEQ ID NO: 1320, or a sequence with 95-99% identity thereof.

In one embodiment, the Y to F mutant ICOS costimulatory domain comprises a sequence of SEQ ID NO: 1321. In one embodiment, the Y to F mutant ICOS costimulatory domain comprises an amino acid sequence having at least one, two or three modifications (e.g., substitutions) but not more than 20, 10 or 5 modifications (e.g., substitutions) of an amino acid sequence of SEQ ID NO: 1321, or a sequence with 95-99% identity to an amino acid sequence of SEQ ID NO: 1321. In one embodiment, the Y to F mutant ICOS costimulatory domain is encoded by a nucleic acid sequence with 95-99% identity to a nucleic acid sequence of SEQ ID NO:1320 (wherein SEQ ID NO: 1320 encodes wild-type ICOS).

In embodiments, the primary signaling domain comprises a functional signaling domain of CD3 zeta. In embodiments, the functional signaling domain of CD3 zeta comprises SEQ ID NO: 17 (mutant CD3 zeta) or SEQ ID NO: 43 (wild-type human CD3 zeta).

In one embodiment, the method includes administering a population of cells wherein at least one cell in the population expresses a CAR, e.g., having an anti-CD19 domain described herein, and an agent which enhances the activity of a CAR-expressing cell, e.g., a second cell expressing the agent which enhances the activity of a CAR-expressing cell. For example, in one embodiment, the agent can be an agent which inhibits an immune inhibitory molecule. Examples of immune inhibitory molecules include PD1, PD-L1, CTLA4, TIM3, CEACAM (e.g., CEACAM-1, CEACAM-3 and/or CEACAM-5), LAG3, VISTA, BTLA, TIGIT, LAIR1, CD160, 2B4 and TGFR beta. In one embodiment, the agent that inhibits an immune inhibitory molecule comprises a first polypeptide, e.g., an inhibitory molecule, associated with a second polypeptide that provides a positive signal to the cell, e.g., an intracellular signaling domain described herein. In one embodiment, the agent comprises a first polypeptide, e.g., of an inhibitory molecule such as PD1, PD-L1, CTLA4, TIM3, CEACAM (e.g., CEACAM-1, CEACAM-3 and/or CEACAM-5), LAG3, VISTA, BTLA, TIGIT, LAIR1, CD160, 2B4 or TGFR beta, or a fragment of any of these (e.g., at least a portion of an extracellular domain of any of these), and a second polypeptide which is an intracellular signaling domain described herein (e.g., comprising a costimulatory domain (e.g., 41BB, CD27 or CD28, e.g., as described herein) and/or a primary signaling domain (e.g., a CD3 zeta signaling domain described herein). In one embodiment, the agent comprises a first polypeptide of PD1 or a fragment thereof (e.g., at least a portion of the extracellular domain of PD1), and a second polypeptide of an intracellular signaling domain described herein (e.g., a CD28 signaling domain described herein and/or a CD3 zeta signaling domain described herein).

In an embodiment, the B-cell inhibitor comprises an inhibitor of one or more of CD10, CD19, CD20, CD22, CD34, FLT-3, or ROR1. In an embodiment, the B-cell inhibitor comprises an effective number of one or more cells that express a CAR molecule that binds one or more of CD10, CD20, CD22, CD34, FLT-3, ROR1, CD79b, CD179b, or CD79a. In an embodiment, the B-cell inhibitor comprises a CD123 CAR. In an embodiment, the B cell inhibitor comprises one or more cells that express a CAR molecule that binds CD123. In an embodiment, the disease is a CD19-negative cancer, e.g., a CD19-negative relapsed cancer. In an embodiment, the CD19 CAR-expressing cell is administered simultaneously with, before, or after the one or more B-cell inhibitor.

In an embodiment, the method further comprises administering a CD19 inhibitor, e.g., a CD19 CAR-expressing cell.

In an embodiment, the CD19 inhibitor comprises a CD19 CAR and the B-cell inhibitor comprises a CD123 CAR. In an embodiment, the CD19 CAR or CD123 CAR comprises a split intracellular signaling domain such that full activation of the cell, e.g., the population of immune effector cells, occurs when both the CD19 CAR and CD123 CAR bind to a target cell, e.g., a target CD19+CD123+ cell (e.g., a B-ALL blast cell), compared to activation when the CD19 CAR and CD123 CAR bind to a target cell that expresses one of CD19 or CD123 (e.g., a hematopoietic stem cell). In an embodiment, the CD123CAR comprises a 4-1BB signaling domain and the CD19 CAR comprises a CD3 zeta signaling domain. In an embodiment, the CD123CAR comprises a costimulatory domain, e.g., a 4-1BB signaling domain, and the CD19 CAR comprises a primary signaling domain, e.g., a CD3 zeta signaling domain. In an embodiment, the CD123CAR comprises a primary signaling domain, e.g., a CD3 zeta signaling domain, and the CD19 CAR comprises a costimulatory domain, e.g., a 4-1BB signaling domain. In an embodiment, the B cell inhibitor comprises a CAR (e.g., a CAR directed against CD10, CD20, CD22, CD34, CD123, FLT-3, ROR1, CD79b, CD179b, or CD79a) which comprises a costimulatory domain, and the CD19 CAR comprises a primary signaling domain. In an embodiment, the B cell inhibitor comprises a CAR (e.g., a CAR directed against CD10, CD20, CD22, CD34, CD123, FLT-3, ROR1, CD79b, CD179b, or CD79a) which comprises a primary signalling domain, and the CD19 CAR comprises a costimulatory domain. In an embodiment, the B-cell inhibitor comprises one or more cells that express a CAR molecule that binds CD123, and wherein a CD19 CAR-expressing cell is administered simultaneously with the B-cell inhibitor. In an embodiment, the CD123CAR comprises a 4-1BB signaling domain and the CD19 CAR comprises a CD3 zeta signaling domain.

In an embodiment, the method further comprises transplanting a cell, e.g., a hematopoietic stem cell, or a bone marrow, into the mammal.

In another aspect, the invention pertains to a cell expressing a CAR molecule described herein, e.g., a CD19 CAR molecule, for use as a medicament in combination with a B-cell inhibitor, e.g., a B-cell inhibitor described herein. In another aspect, the invention pertains to a B-cell inhibitor described herein for use as a medicament in combination with a cell expressing a CAR molecule, e.g., a CD19 CAR molecule, described herein.

In another aspect, the invention pertains to a cell expressing a CAR molecule described herein, e.g., a CD19 CAR molecule, for use in combination with a B-cell inhibitor, e.g., a B-cell inhibitor described herein, in the treatment of a disease expressing CD19. In another aspect, the invention pertains to a B-cell inhibitor described herein for use in combination with a cell expressing a CAR molecule described herein, e.g., a CD19 CAR molecule, in the treatment of a disease expressing CD19. In another aspect, the invention pertains to a cell expressing a CAR molecule described herein, e.g., a CD19 CAR molecule, for use in combination with a B-cell inhibitor, e.g., a B-cell inhibitor described herein, in the treatment of a cancer, e.g., a cancer described herein.

In one embodiment, the method includes administering a population of cells wherein at least one cell in the population expresses a therapy herein (e.g., a CD20 CAR, a CD22 CAR, or a CAR having an anti-CD19 domain described herein in combination with a B-cell inhibitor) and an agent which enhances the activity of a CAR-expressing cell, wherein the agent is a cytokine, e.g., IL-7, IL-15, IL-21, or a combination thereof. The cytokine can be delivered in combination with, e.g., simultaneously or shortly after, administration of the CAR-expressing cell(s). Alternatively, the cytokine can be delivered after a prolonged period of time after administration of the CAR-expressing cell(s), e.g., after assessment of the subject's response to the CAR-expressing cell(s). Related compositions for use and methods of making a medicament are also provided.

In one embodiment, the cells described herein (e.g., cells expressing a CD20 CAR molecule, cells expressing a CD22 CAR molecule, or cells expressing a CD19 CAR molecule, e.g., a CD19 CAR molecule described herein, combination with a B-cell inhibitor) are administered in combination with an agent that increases the efficacy of a cell expressing a CAR molecule or one of the inhibitors, e.g., an agent described herein.

In one embodiment, the cells described herein (e.g., cells expressing a CD20 CAR molecule, cells expressing a CD22 CAR molecule, or expressing a CD19 CAR molecule, e.g., a CD19 CAR molecule described herein, in combination with a B-cell inhibitor) are administered in combination with an agent that ameliorates one or more side effect associated with administration of a cell expressing a CAR molecule or one of the inhibitors, e.g., an agent described herein.

In one embodiment, the cells expressing a CD19 CAR molecule, e.g., a CD19 CAR molecule described herein, are administered in combination with a B-cell inhibitor, and an agent that treats Hodgkin lymphoma, e.g., an agent described herein.

In some aspects, the disclosure provides a method of treating a patient who is a non-responder, partial responder, or relapser to a CD19 inhibitor, e.g., a CD19 CAR therapy, comprising administering to the patient a B-cell inhibitor, e.g., a B-cell inhibitor as described herein, e.g., an inhibitor of one or more of (e.g., 2, 3, 4, 5, 6, 7, 8, 9, or all of) CD10, CD20, CD22, CD34, CD123, FLT-3, ROR1, CD79b, CD179b, or CD79a. In embodiments, the B-cell inhibitor is a CAR-expressing cell (e.g., T cell or NK cell) that is an inhibitor of one or more of (e.g., 2, 3, 4, 5, 6, or all of) CD10, CD20, CD22, CD34, CD123, FLT-3, or ROR1. In embodiments, the patient has, or is identified as having, a CD19-negative cancer cell and a cancer cell that is positive for one or more of (e.g., 2, 3, 4, 5, 6, 7, 8, 9, or all of) CD10, CD20, CD22, CD34, CD123, FLT-3, ROR1, CD79b, CD179b, or CD79a. In embodiments, the method further comprises administering to the patient a B-cell inhibitor for which the cancer cell is positive, e.g., an inhibitor of one or more of (e.g., 2, 3, 4, 5, 6, 7, 8, 9, or all of) the CD10, CD20, CD22, CD34, CD123, FLT-3, ROR1, CD79b, CD179b, or CD79a for which the cancer cell is positive. In embodiments, the method further comprises one or both of a step of determining whether the patient comprises a CD19-negative cancer cell, and a step of determining whether the patient comprises a cancer cell that is positive for one or more of (e.g., 2, 3, 4, 5, 6, 7, 8, 9, or all of) CD10, CD20, CD22, CD34, CD123, FLT-3, ROR1, CD79b, CD179b, or CD79a. In embodiments, the subject has or is identified as having a population of tumor or cancer cells that test negative for CD19 expression as measured by binding to an anti-CD19 antibody, e.g., an antibody with the same specificity as any of the CAR molecules in Table 2 or Table 3.

In another aspect, the invention features a composition comprising a cell expressing a Chimeric Antigen Receptor (CAR) molecule that binds CD19, in combination with a B-cell inhibitor, e.g., a B-cell inhibitor chosen from an inhibitor of CD10, CD19, CD20, CD22, CD34, CD123, FLT-3, ROR1, CD79b, CD179b, or CD79a, or a combination thereof. The CAR-expressing cell and the B-cell inhibitor can be present in a single dose form, or as two or more dose forms.

In an embodiment, the composition is a pharmaceutically acceptable composition.

In embodiments, the compositions disclosed herein (e.g., nucleic acids, vectors, or cells) are for use as a medicament.

In embodiments, the compositions disclosed herein are use in the treatment of a disease associated with expression of a B-cell antigen (e.g., CD19), e.g., a B-cell leukemia or lymphoma.

CD19 Inhibitors

In embodiments, the CD19 inhibitor is a small molecule, an antibody, a fragment of an antibody, or a cell therapy.

In some embodiments, the CD19 inhibitor (e.g., a cell therapy or an antibody) is administered in combination with, or is present in a composition together with, a B cell inhibitor, e.g., one or more inhibitors of CD10, CD19, CD20, CD22, CD34, CD123, FLT-3, ROR1, CD79b, CD179b, or CD79a.

In one embodiment, the cell expresses a CAR molecule comprising an anti-CD19 binding domain (e.g., a murine or humanized antibody or antibody fragment that specifically binds to CD19), a transmembrane domain, and an intracellular signaling domain (e.g., an intracellular signaling domain comprising a costimulatory domain and/or a primary signaling domain). In one embodiment, the CAR comprises an antibody or antibody fragment which includes an anti-CD19 binding domain described herein (e.g., a murine or humanized antibody or antibody fragment that specifically binds to CD19 as described herein), a transmembrane domain described herein, and an intracellular signaling domain described herein (e.g., an intracellular signaling domain comprising a costimulatory domain and/or a primary signaling domain described herein).

In one embodiment, the CAR molecule comprises an anti-CD19 binding domain comprising one or more (e.g., all three) light chain complementary determining region 1 (LC CDR1), light chain complementary determining region 2 (LC CDR2), and light chain complementary determining region 3 (LC CDR3) of an anti-CD19 binding domain described herein, and one or more (e.g., all three) heavy chain complementary determining region 1 (HC CDR1), heavy chain complementary determining region 2 (HC CDR2), and heavy chain complementary determining region 3 (HC CDR3) of an anti-CD19 binding domain described herein, e.g., an anti-CD19 binding domain comprising one or more, e.g., all three, LC CDRs and one or more, e.g., all three, HC CDRs. In one embodiment, the anti-CD19 binding domain comprises one or more (e.g., all three) heavy chain complementary determining region 1 (HC CDR1), heavy chain complementary determining region 2 (HC CDR2), and heavy chain complementary determining region 3 (HC CDR3) of an anti-CD19 binding domain described herein, e.g., the anti-CD19 binding domain has two variable heavy chain regions, each comprising a HC CDR1, a HC CDR2 and a HC CDR3 described herein. In one embodiment, the anti-CD19 binding domain comprises a murine light chain variable region described herein (e.g., in Table 3) and/or a murine heavy chain variable region described herein (e.g., in Table 3). In one embodiment, the anti-CD19 binding domain is a scFv comprising a murine light chain and a murine heavy chain of an amino acid sequence of Table 3. In an embodiment, the anti-CD19 binding domain (e.g., an scFv) comprises: a light chain variable region comprising an amino acid sequence having at least one, two or three modifications (e.g., substitutions) but not more than 30, 20 or 10 modifications (e.g., substitutions) of an amino acid sequence of a light chain variable region provided in Table 3, or a sequence with 95-99% identity with an amino acid sequence of Table 3; and/or a heavy chain variable region comprising an amino acid sequence having at least one, two or three modifications (e.g., substitutions) but not more than 30, 20 or 10 modifications (e.g., substitutions) of an amino acid sequence of a heavy chain variable region provided in Table 3, or a sequence with 95-99% identity to an amino acid sequence of Table 3. In one embodiment, the anti-CD19 binding domain comprises a sequence of SEQ ID NO:59, or a sequence with 95-99% identity thereof. In one embodiment, the anti-CD19 binding domain is a scFv, and a light chain variable region comprising an amino acid sequence described herein, e.g., in Table 3, is attached to a heavy chain variable region comprising an amino acid sequence described herein, e.g., in Table 3, via a linker, e.g., a linker described herein. In one embodiment, the anti-CD19 binding domain includes a (Gly$_4$-Ser)n linker, wherein n is 1, 2, 3, 4, 5, or 6, e.g., 3 or 4 (SEQ ID NO: 53). The light chain variable region and heavy chain variable region of a scFv can be, e.g., in any of the following orientations: light chain variable region-linker-heavy chain variable region or heavy chain variable region-linker-light chain variable region.

In one embodiment, the CAR molecule comprises a humanized anti-CD19 binding domain that includes one or more (e.g., all three) light chain complementary determining region 1 (LC CDR1), light chain complementary determining region 2 (LC CDR2), and light chain complementary determining region 3 (LC CDR3) of a humanized anti-CD19 binding domain described herein, and one or more (e.g., all three) heavy chain complementary determining region 1 (HC CDR1), heavy chain complementary determining region 2 (HC CDR2), and heavy chain complementary determining region 3 (HC CDR3) of a humanized anti-CD19 binding domain described herein, e.g., a humanized anti-CD19 binding domain comprising one or more, e.g., all three, LC CDRs and one or more, e.g., all three, HC CDRs. In one embodiment, the humanized anti-CD19 binding domain comprises at least HC CDR2. In one embodiment, the humanized anti-CD19 binding domain comprises one or more (e.g., all three) heavy chain complementary determining region 1 (HC CDR1), heavy chain complementary determining region 2 (HC CDR2), and heavy chain complementary determining region 3 (HC CDR3) of a humanized anti-CD19 binding domain described herein, e.g., the humanized anti-CD19 binding domain has two variable heavy chain regions, each comprising a HC CDR1, a HC CDR2 and a HC CDR3 described herein. In one embodiment, the humanized anti-CD19 binding domain comprises at least HC CDR2. In one embodiment, the light chain variable region comprises one, two, three or all four framework regions of VK3_L25 germline sequence. In one embodiment, the light chain variable region has a modification (e.g., substitution, e.g., a substitution of one or more amino acid found in the corresponding position in the murine light chain variable region of SEQ ID NO: 58, e.g., a substitution at one or more of positions 71 and 87). In one embodiment, the heavy chain variable region comprises one, two, three or all four framework regions of VH4_4-59 germline sequence. In one embodiment, the heavy chain variable region has a modification (e.g., substitution, e.g., a substitution of one or more amino acid found in the corresponding position in the murine heavy chain variable region of SEQ ID NO: 58, e.g., a substitution at one or more of positions 71, 73 and 78). In one embodiment, the humanized anti-CD19 binding domain comprises a light chain variable region described herein (e.g., in Table 2) and/or a heavy chain variable region described herein (e.g., in Table 2). In one embodiment, the humanized anti-CD19 binding domain is a scFv comprising a light chain and a heavy chain of an amino acid sequence of Table 2. In an embodiment, the humanized anti-CD19 binding domain (e.g., an scFv) comprises: a light chain variable region comprising an amino acid sequence having at least one, two or three modifications (e.g., substitutions) but not more than 30, 20 or 10 modifications (e.g., substitutions) of an amino acid sequence of a light chain variable region provided in Table 2, or a sequence with 95-99% identity with an amino acid sequence of Table 2; and/or a heavy chain variable region comprising an amino acid sequence having at least one, two or three modifications (e.g., substitutions) but not more than 30, 20 or 10 modifications (e.g., substitutions) of an amino acid sequence of a heavy chain variable region provided in Table 2, or a sequence with 95-99% identity to an amino acid sequence of Table 2. In one embodiment, the humanized anti-CD19 binding domain comprises a sequence selected from a group consisting of SEQ ID NO:1, SEQ ID NO:2, SEQ ID NO:3, SEQ ID NO: 4, SEQ ID NO:5, SEQ ID NO:6, SEQ ID NO:7, SEQ ID NO:8, SEQ ID NO:9, SEQ ID NO:10, SEQ ID NO:11 and SEQ ID NO:12, or a sequence with 95-99% identity thereof. In one embodiment, the humanized anti-CD19 binding domain is a scFv, and a light chain variable region comprising an amino acid sequence described herein, e.g., in Table 2, is attached to a heavy chain variable region comprising an amino acid sequence described herein, e.g., in Table 2, via a linker, e.g., a linker described herein. In one embodiment, the humanized anti-CD19 binding domain includes a (Gly$_4$-Ser)n linker, wherein n is 1, 2, 3, 4, 5, or 6, e.g., 3 or 4 (SEQ ID NO: 53). The light chain variable region and heavy chain variable region of a scFv can be, e.g., in any of the following orientations: light chain variable region-linker-heavy chain variable region or heavy chain variable region-linker-light chain variable region.

In one embodiment, the CAR molecule comprises an anti-CD19 binding domain that includes one or more (e.g., 2, 3, 4, 5, or 6) LC CDR1, LC CDR2, LC CDR3, HC CDR1, HC CDR2, and HC CDR3 of a construct of Table 4 and 5, e.g., murine_CART19, humanized_CART19 a, humanized_CART19 b, or humanized_CART19 c.

In one embodiment, the CAR molecule comprises a leader sequence, e.g., a leader sequence described herein, e.g., a leader sequence of SEQ ID NO: 13, or having 95-99% identity thereof; an anti-CD19 binding domain described herein, e.g., an anti-CD19 binding domain comprising a LC CDR1, a LC CDR2, a LC CDR3, a HC CDR1, a HC CDR2 and a HC CDR3 described herein, e.g., a murine anti-CD19 binding domain described in Table 3, a humanized anti-CD19 binding domain described in Table 2, or a sequence with 95-99% identity thereof; a hinge region, e.g., a hinge region described herein, e.g., a hinge region of SEQ ID NO:14 or having 95-99% identity thereof; a transmembrane domain, e.g., a transmembrane domain described herein, e.g., a transmembrane domain having a sequence of SEQ ID NO:15 or a sequence having 95-99% identity thereof; an intracellular signaling domain, e.g., an intracellular signaling domain described herein (e.g., an intracellular signaling domain comprising a costimulatory domain and/or a primary signaling domain). In one embodiment, the intracellular signaling domain comprises a costimulatory domain, e.g., a costimulatory domain described herein, e.g., a 4-1BB costimulatory domain having a sequence of SEQ ID NO:16 or SEQ ID NO:51, or having 95-99% identity thereof, and/or a primary signaling domain, e.g., a primary signaling domain described herein, e.g., a CD3 zeta stimulatory domain having a sequence of SEQ ID NO:17 or SEQ ID NO:43, or having 95-99% identity thereof.

In one embodiment, the CAR molecule comprises (e.g., consists of) an amino acid sequence of SEQ ID NO:58, SEQ ID NO:31, SEQ ID NO:32, SEQ ID NO:33, SEQ ID NO:34, SEQ ID NO:35, SEQ ID NO:36, SEQ ID NO:37, SEQ ID NO:38, SEQ ID NO:39, SEQ ID NO:40, SEQ ID NO:41 or SEQ ID NO:42, or an amino acid sequence having at least one, two, three, four, five, 10, 15, 20 or 30 modifications (e.g., substitutions) but not more than 60, 50 or 40 modifications (e.g., substitutions) of an amino acid sequence of SEQ ID NO:58, SEQ ID NO:31, SEQ ID NO:32, SEQ ID NO:33, SEQ ID NO:34, SEQ ID NO:35, SEQ ID NO:36, SEQ ID NO:37, SEQ ID NO:38, SEQ ID NO:39, SEQ ID NO:40, SEQ ID NO:41 or SEQ ID NO:42, or an amino acid sequence having 85%, 90%, 95%, 96%, 97%, 98% or 99% identity to an amino acid sequence of SEQ ID NO:58, SEQ ID NO:31, SEQ ID NO:32, SEQ ID NO:33, SEQ ID NO:34, SEQ ID NO:35, SEQ ID NO:36, SEQ ID NO:37, SEQ ID NO:38, SEQ ID NO:39, SEQ ID NO:40, SEQ ID NO:41 or SEQ ID NO:42.

The present invention relates generally, in some aspects, to the use of cells, e.g., T cells or natural killer (NK) cells, engineered to express a CAR in combination with one or more B-cell inhibitors to treat a disease associated with expression of the Cluster of Differentiation 19 protein (CD19). In some embodiments, the B-cell inhibitor is an inhibitor of one or more of CD10, CD19, CD20, CD22, CD34, CD123, FLT-3, ROR1, CD79b, CD179b, or CD79a.

In some embodiments, the CD19 inhibitor comprises an antibody molecule having, e.g., an antibody molecule having a CD19-binding sequence as described herein. For instance, the antibody molecule may comprise CDRs or a VH and VL as described in any of Tables 2, 3, 4, and 5, or a sequence with homology thereto, e.g., having 95-99% identity thereto. The antibody molecule may comprise a CD19-binding region having a sequence described in this section, e.g., in the context of a CAR.

In embodiments, the B-cell inhibitor is chosen from an inhibitory nucleic acid, a soluble ligand, an antibody or antigen-binding fragment thereof, a CAR, or a CAR-expressing cell that binds to one or more B-cell antigens, e.g., one or more of CD10, CD19, CD20, CD22, CD34, CD123, FLT-3, ROR1, CD79b, CD179b, or CD79a.

CD20 Binding Domains and Inhibitors

In some aspects, the present disclosure provides a CD20 inhibitor or binding domain, e.g., a CD20 inhibitor or binding domain as described herein. The disclosure also provides a nucleic acid encoding the CD20 binding domain, e.g., encoding a CAR comprising the CD20 binding domain. The composition may also comprise a second agent, e.g., an anti-CD19 CAR-expressing cell or a CD19 binding domain. The agents may be, e.g., encoded by a single nucleic acid or different nucleic acids.

In some aspects, a CD20 inhibitor or binding domain is administered as a monotherapy. In some aspects, the CD20 inhibitor or binding domain is administered in combination with a second agent such as an anti-CD19 CAR-expressing cell.

The CD20 inhibitor may be, e.g., a small molecule, antibody or antigen-binding fragment thereof, a CAR or a CAR-expressing cell. In one embodiment, the CD20 inhibitor is an anti-CD20 antibody or fragment thereof. In an embodiment, the antibody is a monospecific antibody and in another embodiment the antibody is a bispecific antibody. In an embodiment, the CD20 inhibitor is a chimeric mouse/ human monoclonal antibody, e.g., rituximab. In an embodiment, the CD20 inhibitor is a human monoclonal antibody such as ofatumumab. In an embodiment, the CD20 inhibitor is a humanized antibody such as ocrelizumab, veltuzumab, obinutuzumab, ocaratuzumab, or PRO131921 (Genentech). In an embodiment, the CD20 inhibitor is a fusion protein comprising a portion of an anti-CD20 antibody, such as TRU-015 (Trubion Pharmaceuticals).

In one embodiment, the CD20 inhibitor is an anti-CD20 expressing cell, e.g., CD20 CART or CD20-expressing NK cell.

In some embodiments, the CD20-CAR comprises an optional leader sequence (e.g., an optional leader sequence described herein), an extracellular antigen binding domain, a hinge (e.g., hinge described herein), a transmembrane domain (e.g., transmembrane domain described herein), and an intracellular stimulatory domain (e.g., intracellular stimulatory domain described herein). In one embodiment, an exemplary CD20 CAR construct comprises an optional leader sequence (e.g., a leader sequence described herein), an extracellular antigen binding domain, a hinge, a transmembrane domain, an intracellular costimulatory domain (e.g., an intracellular costimulatory domain described herein) and an intracellular stimulatory domain.

In one embodiment, the CD20 binding domain comprises one or more (e.g., all three) light chain complementary determining region 1 (LC CDR1), light chain complementary determining region 2 (LC CDR2), and light chain complementary determining region 3 (LC CDR3) of a CD20 binding domain described herein, and/or one or more (e.g., all three) heavy chain complementary determining region 1 (HC CDR1), heavy chain complementary determining region 2 (HC CDR2), and heavy chain complementary determining region 3 (HC CDR3) of a CD20 binding domain described herein, e.g., a CD20 binding domain comprising one or more, e.g., all three, LC CDRs and one or more, e.g., all three, HC CDRs. These CDRs may be, e.g., those of Table 12A, 12B, and/or Table 13. In one embodiment, the CD20 binding domain comprises one or more (e.g., all three) heavy chain complementary determining region 1 (HC CDR1), heavy chain complementary determining region 2 (HC CDR2), and heavy chain complementary determining region 3 (HC CDR3) of a CD20 binding domain described herein, e.g., the CD20 binding domain has two variable heavy chain regions, each comprising a HC CDR1, a HC CDR2 and a HC CDR3 described herein. In one embodiment, the CD20 binding domain comprises a light chain variable region described herein (e.g., in Table 15A or 15B) and/or a heavy chain variable region described herein (e.g., in Table 14A or 14B). In one embodiment, the CD20 binding domain comprises a heavy chain variable region described herein (e.g., in Table 14A or 14B), e.g., at least two heavy chain variable regions described herein (e.g., in Table 14A or 14B). In one embodiment, the CD20 binding domain is a scFv comprising a light chain and a heavy chain of an amino acid sequence of Table 14A or 14B or 15A or 15B. In one embodiment, the CD20 binding domain (e.g., an scFv) comprises: a light chain variable region comprising an amino acid sequence having at least one, two or three modifications (e.g., substitutions) but not more than 30, 20 or 10 modifications (e.g., substitutions) of an amino acid sequence of a light chain variable region provided in Table 15A or 15B, or a sequence with 95-99% identity with an amino acid sequence of Table 15A or 15B; and/or a heavy chain variable region comprising an amino acid sequence having at least one, two or three modifications (e.g., substitutions) but not more than 30, 20 or 10 modifications (e.g., substitutions) of an amino acid sequence of a heavy chain variable region provided in Table 14A or 14B, or a sequence with 95-99% identity to an amino acid sequence of Table 14A or 14B. The CD20 binding domain may be part of, e.g., an antibody molecule or a CAR molecule.

In one embodiment, the CAR molecule comprises an anti-CD20 binding domain that includes one or more (e.g., 2, 3, 4, 5, or 6) LC CDR1, LC CDR2, LC CDR3, HC CDR1, HC CDR2, and HC CDR3 of a construct of Table 12A, 12B, and/or 13, e.g., CAR20-1, CAR20-2, CAR20-3, CAR20-4, CAR20-5, CAR20-6, CAR20-7, CAR20-8, CAR20-9, CAR20-10, CAR20-11, CAR20-12, CAR20-13, CAR20-14, CAR20-15, or CAR20-16.

In one embodiment, the CAR molecule comprises an anti-CD22 binding domain that includes a VL and/or VH of a construct of Table 14A or 14B and 15A or 15B, e.g., CAR20-1, CAR20-2, CAR20-3, CAR20-4, CAR20-5, CAR20-6, CAR20-7, CAR20-8, CAR20-9, CAR20-10, CAR20-11, CAR20-12, CAR20-13, CAR20-14, CAR20-15, or CAR20-16.

The CD20 scFv may be preceded by an optional leader sequence such as provided in SEQ ID NO: 13, and followed by an optional hinge sequence such as provided in SEQ ID NO: 14 or SEQ ID NO:45 or SEQ ID NO:47 or SEQ ID NO:49, a transmembrane region such as provided in SEQ ID NO:15, an intracellular signalling domain that includes SEQ ID NO:16 or SEQ ID NO:51 and a CD3 zeta sequence that includes SEQ ID NO:17 or SEQ ID NO:43, e.g., wherein the domains are contiguous with and in the same reading frame to form a single fusion protein.

Further embodiments include a nucleotide sequence that encodes a polypeptide of any of Tables 11A-15B Further embodiments include a nucleotide sequence that encodes a polypeptide any of Tables 11A-15B, and each of the domains of SEQ ID NOS: 13, 14, 15, 16, 17, and optionally 51.

In one embodiment, the CD20 binding domain is characterized by particular functional features or properties of an antibody or antibody fragment. For example, in one embodiment, the portion of a CAR composition of the invention that comprises an antigen binding domain specifically binds human CD20 or a fragment thereof.

In one embodiment, the CD20 binding domain is a fragment, e.g., a single chain variable fragment (scFv). In one embodiments, the CD20 binding domain is a Fv, a Fab, a (Fab')2, or a bi-functional (e.g. bi-specific) hybrid antibody (e.g., Lanzavecchia et al., Eur. J. Immunol. 17, 105 (1987)). In one aspect, the antibodies and fragments thereof of the invention binds a CD20 protein or a fragment thereof with wild-type or enhanced affinity. In some instances, a human scFv can be derived from a display library.

In one embodiment, the CD20 binding domain, e.g., scFv comprises at least one mutation such that the mutated scFv confers improved stability to the CART20 construct. In another embodiment, the CD20 binding domain, e.g., scFv comprises at least 1, 2, 3, 4, 5, 6, 7, 8, 9, 10 mutations arising, e.g., from the humanization process, such that the mutated scFv confers improved stability to the CART20 construct.

In some embodiments, the CD20 inhibitor comprises an antibody molecule having, e.g., an antibody molecule having a CD20-binding sequence as described herein. For instance, the antibody molecule may comprise CDRs or a VH and VL as described in any of Tables 11A-15B, or a sequence with homology thereto, e.g., having 95-99% identity thereto. The antibody molecule may comprise a CD20- binding region having a sequence described in this section, e.g., in the context of a CAR.

In one aspect, the present disclosure provides a population of CAR-expressing cells, e.g., CART cells, comprising a mixture of cells expressing CD19 CARs and CD20 CARs. For example, in one embodiment, the population of CART cells can include a first cell expressing a CD19 CAR and a second cell expressing a CD20 CAR.

In some aspects, a binding domain or antibody molecule described herein binds the same (or substantially the same) or an overlapping (or substantially overlapping) epitope with a second antibody molecule to CD20, wherein the second antibody molecule is an antibody molecule described herein, e.g., an antibody molecule chosen from Tables 11A-15B. In some embodiments, a binding domain or antibody molecule described herein competes for binding, and/or binds the same (or substantially the same) or overlapping (or substantially overlapping) epitope, with a second antibody molecule to CD20, wherein the second antibody molecule is an antibody molecule described herein, e.g., an antibody molecule chosen from Tables 11A-15B, e.g., as determined by the methods described in Example 25. In some embodiments, a biparatopic CD20 binding domain binds a first epitope, e.g., an epitope bound by an antibody molecule chosen from Tables 11A-15B, and the biparatopic binding domain also binds a second epitope, e.g., a second epitope bound by an antibody molecule chosen from Tables 11A-15B. In some aspects, the present disclosure provides a method of treatment comprising administering a first CD20 binding domain that binds a first epitope, e.g., an epitope bound by an antibody molecule chosen from Tables 11A-15B and a second CD20 binding domain that binds a second epitope, e.g., a second epitope bound by an antibody molecule chosen from Tables 11A-15B. In some embodiments, the CD20 binding domains are part of CAR molecules, e.g., expressed by a CAR-expressing cell.

CD22 Binding Domains and Inhibitors

In some aspects, the present disclosure provides a CD22 inhibitor or binding domain, e.g., a CD22 inhibitor or binding domain as described herein. The disclosure also provides a nucleic acid encoding the CD22 binding domain, e.g., encoding a CAR comprising the CD22 binding domain. The composition may also comprise a second agent, e.g., an anti-CD19 CAR-expressing cell or a CD19 binding domain. The agents may be, e.g., encoded by a single nucleic acid or different nucleic acids.

In some aspects, a CD22 inhibitor or binding domain is administered as a monotherapy. In some aspects, the CD22 inhibitor or binding domain is administered in combination with a second agent such as an anti-CD19 CAR-expressing cell.

The CD22 inhibitor may be, e.g., a small molecule, antibody or antigen-binding fragment thereof, a CAR or a CAR-expressing cell. In one embodiment, the CD22 inhibitor is an anti-CD22 antibody or fragment thereof. In an embodiment, the antibody is a monospecific antibody and in another embodiment the antibody is a bispecific antibody. In an embodiment, the antibody is a monospecific antibody, optionally conjugated to a second agent such as a chemotherapeutic agent. For instance, in an embodiment the antibody is an anti-CD22 monoclonal antibody-MMAE conjugate (e.g., DCDT2980S). In an embodiment, the antibody is an scFv of an anti-CD22 antibody, e.g., an scFv of antibody RFB4. This scFv can be fused to all of or a fragment of Pseudomonas exotoxin-A (e.g., BL22). In an embodiment, the antibody is a humanized anti-CD22 monoclonal antibody (e.g., epratuzumab). In an embodiment, the antibody or fragment thereof comprises the Fv portion of an anti-CD22 antibody, which is optionally covalently fused to all or a fragment or (e.g., a 38 KDa fragment of) Pseudomonas exotoxin-A (e.g., moxetumomab pasudotox). In an embodiment, the anti-CD22 antibody is an anti-CD19/CD22 bispecific antibody, optionally conjugated to a toxin. For instance, in one embodiment, the anti-CD22 antibody comprises an anti-CD19/CD22 bispecific portion, (e.g., two scFv ligands, recognizing human CD19 and CD22) optionally linked to all of or a portion of diphtheria toxin (DT), e.g., first 389 amino acids of diphtheria toxin (DT), DT 390, e.g., a ligand-directed toxin such as DT2219ARL). In another embodiment, the bispecific portion (e.g., anti-CD19/anti-CD22) is linked to a toxin such as deglycosylated ricin A chain (e.g., Combotox).

In one embodiment, the CD22 inhibitor is an anti-CD22 expressing cell, e.g., a CD22 CART or CD22-expressing NK cell.

In one aspect, the present disclosure provides a population of CAR-expressing cells, e.g., CART cells, comprising a mixture of cells expressing CD19 CARs and CD22 CARs. For example, in one embodiment, the population of CART cells can include a first cell expressing a CD19 CAR and a second cell expressing a CD22 CAR. As another example, the population of CAR T cells can include a single population expressing more than one, e.g., 2, 3, 4, 5, or 6 or more, CARs, e.g., a CD19 CAR and a CD22 CAR.

In some embodiments, the CD22-CAR comprises an optional leader sequence (e.g., an optional leader sequence described herein), an extracellular antigen binding domain, a hinge (e.g., hinge described herein), a transmembrane domain (e.g., transmembrane domain described herein), and an intracellular stimulatory domain (e.g., intracellular stimulatory domain described herein). In one embodiment, an exemplary CD22 CAR construct comprises an optional leader sequence (e.g., a leader sequence described herein), an extracellular antigen binding domain, a hinge, a transmembrane domain, an intracellular costimulatory domain (e.g., an intracellular costimulatory domain described herein) and an intracellular stimulatory domain.

In one embodiment, the CD22 binding domain comprises one or more (e.g., all three) light chain complementary determining region 1 (LC CDR1), light chain complementary determining region 2 (LC CDR2), and light chain complementary determining region 3 (LC CDR3) of a CD22 binding domain described herein, and/or one or more (e.g., all three) heavy chain complementary determining region 1 (HC CDR1), heavy chain complementary determining region 2 (HC CDR2), and heavy chain complementary determining region 3 (HC CDR3) of a CD22 binding domain described herein, e.g., a CD22 binding domain comprising one or more, e.g., all three, LC CDRs and one or more, e.g., all three, HC CDRs. These CDRs may be, e.g., one or more CDRs of Table 7A, 7B, 7C, 8A and/or 8B. In one embodiment, the CD22 binding domain comprises one or more (e.g., all three) heavy chain complementary determining region 1 (HC CDR1), heavy chain complementary determining region 2 (HC CDR2), and heavy chain complementary determining region 3 (HC CDR3) of a CD22 binding domain described herein, e.g., the CD22 binding domain has two variable heavy chain regions, each comprising a HC CDR1, a HC CDR2 and a HC CDR3 described herein. In one embodiment, the CD22 binding domain comprises a light chain variable region described herein (e.g., in Table 10A or 10B) and/or a heavy chain variable region described herein (e.g., in Table 9A or 9B). In one embodiment, the CD22 binding domain comprises a heavy chain variable region described herein (e.g., in Table 9A or 9B), e.g., at least two heavy chain variable regions described herein (e.g., in Table 9A or 9B). In one embodiment, the CD22 binding domain is a scFv comprising a light chain and a heavy chain of an amino acid sequence of Table 9A or 9B and 10A or 10B. In an embodiment, the CD22 binding domain (e.g., an scFv) comprises: a light chain variable region comprising an amino acid sequence having at least one, two or three modifications (e.g., substitutions) but not more than 30, 20 or 10 modifications (e.g., substitutions) of an amino acid sequence of a light chain variable region provided in Table 10A or 10B, or a sequence with 95-99% identity with an amino acid sequence of Table 10A or 10B; and/or a heavy chain variable region comprising an amino acid sequence having at least one, two or three modifications (e.g., substitutions) but not more than 30, 20 or 10 modifications (e.g., substitutions) of an amino acid sequence of a heavy chain variable region provided in Table 9A or 9B, or a sequence with 95-99% identity to an amino acid sequence of Table 9A or 9B. The CD22 binding domain may be part of, e.g., an antibody molecule or a CAR molecule.

In one embodiment, the CAR molecule comprises an anti-CD22 binding domain that includes one or more (e.g., 2, 3, 4, 5, or 6) LC CDR1, LC CDR2, LC CDR3, HC CDR1, HC CDR2, and HC CDR3 of a construct of Table 7A, 7B, 7C, 8A and/or 8B, e.g., m971, CAR22-1, CAR22-2, CAR22-3, CAR22-4, CAR22-5, CAR22-6, CAR22-7, CAR22-8, CAR22-9, CAR22-10, CAR22-11, CAR22-12, CAR22-13, CAR22-14, CAR22-15, CAR22-16, CAR22-17, CAR22-18, CAR22-19, CAR22-20, CAR22-21, CAR22-22, CAR22-23, CAR22-24, CAR22-25, CAR22-26, CAR22-27, CAR22-28, CAR22-29, CAR22-30, CAR22-31, CAR22-32, CAR22-33, CAR22-34, CAR22-35, CAR22-36, CAR22-37, or CAR22-38.

In one embodiment, the CAR molecule comprises an anti-CD22 binding domain that includes a VL and/or VH of a construct of Table 9A, 9B, 10A, and/or 10B, e.g., m971, CAR22-1, CAR22-2, CAR22-3, CAR22-4, CAR22-5, CAR22-6, CAR22-7, CAR22-8, CAR22-9, CAR22-10, CAR22-11, CAR22-12, CAR22-13, CAR22-14, CAR22-15, CAR22-16, CAR22-17, CAR22-18, CAR22-19, CAR22-20, CAR22-21, CAR22-22, CAR22-23, CAR22-24, CAR22-25, CAR22-26, CAR22-27, CAR22-28, CAR22-29, CAR22-30, CAR22-31, CAR22-32, CAR22-33, CAR22-34, CAR22-35, CAR22-36, CAR22-37, or CAR22-38, or a sequence with 95-99% identity thereto.

The scFv may be preceded by an optional leader sequence such as provided in SEQ ID NO: 13, and followed by an optional hinge sequence such as provided in SEQ ID NO: 14 or SEQ ID NO:45 or SEQ ID NO:47 or SEQ ID NO:49, a transmembrane region such as provided in SEQ ID NO:15, an intracellular signalling domain that includes SEQ ID NO:16 or SEQ ID NO:51 and a CD3 zeta sequence that includes SEQ ID NO:17 or SEQ ID NO:43, e.g., wherein the domains are contiguous with and in the same reading frame to form a single fusion protein.

Further embodiments include a nucleotide sequence that encodes a polypeptide of any of Tables 6A-10B. Further embodiments include a nucleotide sequence that encodes a polypeptide of any of Tables 6A-10B, and each of the domains of SEQ ID NOS: 13, 14, 15, 16, 17, and optionally 51.

In one embodiment, the CD22 binding domain is characterized by particular functional features or properties of an antibody or antibody fragment. For example, in one embodiment, the portion of a CAR composition of the invention that comprises an antigen binding domain specifically binds human CD22 or a fragment thereof.

In one embodiment, the CD22 binding domain is a fragment, e.g., a single chain variable fragment (scFv). In one embodiments, the CD22 binding domain is a Fv, a Fab, a (Fab')2, or a bi-functional (e.g. bi-specific) hybrid antibody (e.g., Lanzavecchia et al., Eur. J. Immunol. 17, 105 (1987)). In one aspect, the antibodies and fragments thereof of the invention binds a CD22 protein or a fragment thereof with wild-type or enhanced affinity. In some instances, a human scFv can be derived from a display library.

In one embodiment, the CD22 binding domain, e.g., scFv comprises at least one mutation such that the mutated scFv confers improved stability to the CART22 construct. In another embodiment, the CD22 binding domain, e.g., scFv comprises at least 1, 2, 3, 4, 5, 6, 7, 8, 9, 10 mutations arising, e.g., from the humanization process such that the mutated scFv confers improved stability to the CART22 construct.

In some embodiments, the CD22 inhibitor comprises an antibody molecule having, e.g., an antibody molecule having a CD22-binding sequence as described herein. For instance, the antibody molecule may comprise CDRs or a VH and VL as described in any of Tables 6A-10B, or a sequence with homology thereto, e.g., having 95-99% identity thereto. The antibody molecule may comprise a CD22-binding region having a sequence described in this section, e.g., in the context of a CAR.

In one embodiment, the present disclosure provides a population of CAR-expressing cells, e.g., CART cells, comprising a mixture of cells expressing CD19 CARs and CD22 CARs. For example, in one embodiment, the population of CART cells can include a first cell expressing a CD19 CAR and a second cell expressing a CD22 CAR.

In some aspects, a binding domain or antibody molecule described herein binds the same (or substantially the same) or an overlapping (or substantially overlapping) epitope with a second antibody molecule to CD22, wherein the second antibody molecule is an antibody molecule described herein, e.g., an antibody molecule chosen from Tables 6A-10B. In some embodiments, a binding domain or antibody molecule described herein competes for binding, and/or binds the same (or substantially the same) or overlapping (or substantially overlapping) epitope, with a second antibody molecule to CD22, wherein the second antibody molecule is an antibody molecule described herein, e.g., an antibody molecule chosen from Tables 6A-10B, e.g., as determined by the methods described in Example 25. In some embodiments, a biparatopic CD22 binding domain binds a first epitope, e.g., an epitope bound by an antibody molecule chosen from Tables 6A-10B, and the biparatopic binding domain also binds a second epitope, e.g., a second epitope bound by an antibody molecule chosen from Tables 6A-10B. In some aspects, the present disclosure provides a method of treatment comprising administering a first CD22 binding domain that binds a first epitope, e.g., an epitope bound by an antibody molecule chosen from Tables 6A-10B and a second CD22 binding domain that binds a second epitope, e.g., a second epitope bound by an antibody molecule chosen from Tables 6A-10B. In some embodiments, the CD22 binding domains are part of CAR molecules, e.g., expressed by a CAR-expressing cell.

In some embodiments, a CD22 binding domain binds to one or more of Ig-like domains 1, 2, 3, 4, 5, 6, or 7 of CD22. In some embodiments, the CD22 binding domain binds to domains 1 and 2; to domains 3 and 4; or to domains 5, 6, and 7.

In some aspects, this disclosure provides a method of treating a CD19-negative cancer, e.g., a leukemia, e.g., an ALL, e.g., B-ALL, comprising administering a CD22 inhibitor, e.g., a CD22 binding domain or CD22 CAR-expressing cell described herein. In some embodiments, the method includes a step of determining whether the cancer is CD19-negative. In some embodiments, the subject has received a CD19 inhibitor, e.g., a CD19 CAR-expressing cell, and is resistant, relapsed, or refractory to the CD19 inhibitor.

ROR1 Inhibitors

The ROR1 inhibitor may be, e.g., a small molecule, antibody, or fragment thereof. In one embodiment, the ROR1 inhibitor is an anti-ROR1 antibody or fragment thereof. In one embodiment, the anti-ROR1 antibody or fragment thereof is a monoclonal antibody, e.g., cirmtuzumab.

In one embodiment, the ROR1 inhibitor is an anti-ROR1 expressing cell, e.g., ROR1 CART or ROR1-expressing NK cell.

In some embodiments, the ROR1-CAR comprises an optional leader sequence (e.g., an optional leader sequence described herein), an extracellular antigen binding domain, a hinge (e.g., hinge described herein), a transmembrane domain (e.g., transmembrane domain described herein), and an intracellular stimulatory domain (e.g., intracellular stimulatory domain described herein). In one embodiment, an exemplary ROR1 CAR construct comprises an optional leader sequence (e.g., a leader sequence described herein), an extracellular antigen binding domain, a hinge, a transmembrane domain, an intracellular costimulatory domain (e.g., an intracellular costimulatory domain described herein) and an intracellular stimulatory domain.

In one embodiment the ROR1 binding domain comprises an scFv portion, e.g., a human scFv portion. The scFv the scFv may be preceded by an optional leader sequence such as provided in SEQ ID NO: 13, and followed by an optional hinge sequence such as provided in SEQ ID NO: 14 or SEQ ID NO:45 or SEQ ID NO:47 or SEQ ID NO:49, a transmembrane region such as provided in SEQ ID NO:15, an intracellular signalling domain that includes SEQ ID NO:16 or SEQ ID NO:51 and a CD3 zeta sequence that includes SEQ ID NO:17 or SEQ ID NO:43, e.g., wherein the domains are contiguous with and in the same reading frame to form a single fusion protein.

In some embodiments, the present disclosure encompasses a recombinant nucleic acid construct comprising a nucleic acid molecule encoding a ROR1 CAR, wherein the nucleic acid molecule comprises the nucleic acid sequence encoding a ROR1 binding domain, e.g., described herein, e.g., that is contiguous with and in the same reading frame as a nucleic acid sequence encoding an intracellular signaling domain. An exemplary intracellular signaling domain that can be used in the CAR includes, but is not limited to, one or more intracellular signaling domains of, e.g., CD3-zeta, CD28, 4-1BB, and the like. In some instances, the CAR can comprise any combination of CD3-zeta, CD28, 4-1BB, and the like.

In one embodiment, the ROR1 binding domain is characterized by particular functional features or properties of an antibody or antibody fragment. For example, in one embodiment, the portion of a CAR composition of the invention that comprises an antigen binding domain specifically binds human ROR1 or a fragment thereof. In certain embodiments, the scFv is contiguous with and in the same reading frame as a leader sequence. In one aspect the leader sequence is the polypeptide sequence provided as SEQ ID NO:13.

In one embodiment, the ROR1 binding domain is a fragment, e.g., a single chain variable fragment (scFv). In one embodiments, the ROR1 binding domain is a Fv, a Fab, a (Fab')2, or a bi-functional (e.g. bi-specific) hybrid antibody (e.g., Lanzavecchia et al., Eur. J. Immunol. 17, 105 (1987)). In one aspect, the antibodies and fragments thereof of the invention binds a ROR1 protein or a fragment thereof with wild-type or enhanced affinity. In some instances, a human scFv can be derived from a display library.

In one embodiment, the ROR1 binding domain, e.g., scFv comprises at least one mutation such that the mutated scFv confers improved stability to the ROR1 CART construct. In another embodiment, the ROR1 binding domain, e.g., scFv comprises at least 1, 2, 3, 4, 5, 6, 7, 8, 9, 10 mutations arising from the humanization process such that the mutated scFv confers improved stability to the ROR1 CART construct.

In one embodiment, the present disclosure provides a population of CAR-expressing cells, e.g., CART cells, comprising a mixture of cells expressing CD19 CARs and ROR1 CARs. For example, in one embodiment, the population of CART cells can include a first cell expressing a CD19 CAR and a second cell expressing a ROR1 CAR.

CD123 Inhibitors

The CD123 inhibitor may be, e.g., a small molecule, antibody, or fragment thereof (e.g., a monospecific or bispecific antibody or fragment thereof); a recombinant protein, e.g., fusion protein, that binds to CD123; inhibitory nucleic acid; or a cell expressing a CD123 CAR, e.g., a CD123 CART.

In one embodiment, the CD123 inhibitor is a recombinant protein, e.g., comprising the natural ligand (or a fragment) of the CD123 receptor, e.g., SL-401 (also called DT388IL3; University of Texas Southwestern Medical Center).

In another embodiment, the CD123 inhibitor is an anti-CD123 antibody or fragment thereof, e.g., a monoclonal antibody (e.g., a monospecific or bispecific antibody or fragment thereof), such as CSL360 (CSL Limited), CSL362 (CSL Limited), or MGD006 (MacroGenics).

In one embodiment, the CD123 inhibitor is an anti-CD123 CAR expressing cell, e.g., CD123 CART or CD123 CAR-expressing NK cell.

In some embodiments, the CD123-CAR comprises an optional leader sequence (e.g., an optional leader sequence described herein), an extracellular antigen binding domain, a hinge (e.g., hinge described herein), a transmembrane domain (e.g., transmembrane domain described herein), and an intracellular stimulatory domain (e.g., intracellular stimulatory domain described herein). In one embodiment, an exemplary CD123 CAR construct comprises an optional leader sequence (e.g., a leader sequence described herein), an extracellular antigen binding domain, a hinge, a transmembrane domain, an intracellular costimulatory domain (e.g., an intracellular costimulatory domain described herein) and an intracellular stimulatory domain.

In one embodiment, the CD123 binding domain comprises one or more (e.g., all three) light chain complementary determining region 1 (LC CDR1), light chain complementary determining region 2 (LC CDR2), and light chain complementary determining region 3 (LC CDR3) of a CD20 binding domain described herein, and/or one or more (e.g., all three) heavy chain complementary determining region 1 (HC CDR1), heavy chain complementary determining region 2 (HC CDR2), and heavy chain complementary determining region 3 (HC CDR3) of a CD123 binding domain described herein, e.g., a CD123 binding domain comprising one or more, e.g., all three, LC CDRs and one or more, e.g., all three, HC CDRs. These CDRs may be, e.g., those of any of Tables 17, 18, 26, or 27. In one embodiment, the CD123 binding domain comprises one or more (e.g., all three) heavy chain complementary determining region 1 (HC CDR1), heavy chain complementary determining region 2 (HC CDR2), and heavy chain complementary determining region 3 (HC CDR3) of a CD123 binding domain described herein, e.g., the CD123 binding domain has two variable heavy chain regions, each comprising a HC CDR1, a HC CDR2 and a HC CDR3 described herein. In one embodiment, the CD123 binding domain comprises a light chain variable region described herein and/or a heavy chain variable region described herein. In one embodiment, the CD123 binding domain comprises a heavy chain variable region described herein, e.g., at least two heavy chain variable regions described herein. In one embodiment, the CD123 binding domain is a scFv comprising a light chain and a heavy chain of an amino acid sequence of Table 16 or 25. In an embodiment, the CD123 binding domain (e.g., an scFv) comprises: a light chain variable region comprising an amino acid sequence having at least one, two or three modifications (e.g., substitutions) but not more than 30, 20 or 10 modifications (e.g., substitutions) of an amino acid sequence of a light chain variable region in Table 16 or 25, or a sequence with 95-99% identity with a light chain variable region in Table 16 or 25; and/or a heavy chain variable region comprising an amino acid sequence having at least one, two or three modifications (e.g., substitutions) but not more than 30, 20 or 10 modifications (e.g., substitutions) of an amino acid sequence of a heavy chain variable region in Table 16 or 25, or a sequence with 95-99% identity to a heavy chain variable region in Table 16 or 25.

In one embodiment, the CAR molecule comprises an anti-CD123 binding domain that includes one or more (e.g., 2, 3, 4, 5, or 6) LC CDR1, LC CDR2, LC CDR3, HC CDR1, HC CDR2, and HC CDR3 of a construct of Table 17 and 18, e.g., CAR123-1, CAR123-2, CAR123-3, or CAR123-4. In one embodiment, the CAR molecule comprises an anti-CD123 binding domain that includes one or more (e.g., 2, 3, 4, 5, or 6) LC CDR1, LC CDR2, LC CDR3, HC CDR1, HC CDR2, and HC CDR3 of a construct of Table 26 and 27, e.g., hzCAR123.

The CD123 scFv may be preceded by an optional leader sequence such as provided in SEQ ID NO: 13, and followed by an optional hinge sequence such as provided in SEQ ID NO: 14 or SEQ ID NO:45 or SEQ ID NO:47 or SEQ ID NO:49, a transmembrane region such as provided in SEQ ID NO:15, an intracellular signalling domain that includes SEQ ID NO:16 or SEQ ID NO:51 and a CD3 zeta sequence that includes SEQ ID NO:17 or SEQ ID NO:43, e.g., wherein the domains are contiguous with and in the same reading frame to form a single fusion protein.

Further embodiments include a nucleotide sequence that encodes a polypeptide of any of Tables 16-27. Further embodiments include a nucleotide sequence that encodes a polypeptide any of Tables 16-27, and each of the domains of SEQ ID NOS: 13, 14, 15, 16, 17, and optionally 51.

In one embodiment, the CD123 binding domain is characterized by particular functional features or properties of an antibody or antibody fragment. For example, in one embodiment, the portion of a CAR composition of the invention that comprises an antigen binding domain specifically binds human CD123 or a fragment thereof.

In one embodiment, the CD123 binding domain is a fragment, e.g., a single chain variable fragment (scFv). In one embodiments, the CD123 binding domain is a Fv, a Fab, a (Fab')2, or a bi-functional (e.g. bi-specific) hybrid antibody (e.g., Lanzavecchia et al., Eur. J. Immunol. 17, 105 (1987)).

In one aspect, the antibodies and fragments thereof of the invention binds a CD123 protein or a fragment thereof with wild-type or enhanced affinity. In some instances, a human scFv can be derived from a display library.

In one embodiment, the CD123 binding domain, e.g., scFv comprises at least one mutation such that the mutated scFv confers improved stability to the CART123 construct. In another embodiment, the CD123 binding domain, e.g., scFv comprises at least 1, 2, 3, 4, 5, 6, 7, 8, 9, 10 mutations arising, e.g., from the humanization process, such that the mutated scFv confers improved stability to the CART123 construct.

In some embodiments, the CD123 inhibitor comprises an antibody molecule, e.g., an antibody molecule having a CD123-binding sequence as described herein. For instance, the antibody molecule may comprise CDRs or a VH and VL as described in any of Tables 16-27, or a sequence with homology thereto, e.g., having 95-99% identity thereto. The antibody molecule may comprise a CD123-binding region having a sequence described in this section, e.g., in the context of a CAR.

In one embodiment, the present disclosure provides a population of CAR-expressing cells, e.g., CART cells, comprising a mixture of cells expressing CD19 CARs and CD123 CARs. For example, in one embodiment, the population of CART cells can include a first cell expressing a CD19 CAR and a second cell expressing a CD123 CAR.

CD10 Inhibitors

The CD10 inhibitor may be, e.g., a small molecule, antibody, or fragment thereof (e.g., a monospecific or bispecific antibody or fragment thereof); a recombinant protein, e.g., fusion protein, that binds to CD10; inhibitory nucleic acid; or a cell expressing a CD10 CAR, e.g., a CD10 CART.

In an embodiment, the CD10 inhibitor comprises a small molecule, such as sacubitril (Novartis), valsartan/sacubritril (Novartis), omapatrilat (Bristol-Myers Squibb), RB-101, UK-414,495 (Pfizer), or a pharmaceutically acceptable salt or a derivative thereof.

In one embodiment, the CD10 inhibitor is an anti-CD10 CAR expressing cell, e.g., CD10 CART or CD10 CAR-expressing NK cell.

In one embodiment, the present disclosure provides a population of CAR-expressing cells, e.g., CART cells, comprising a mixture of cells expressing CD19 CARs and CD10 CARs. For example, in one embodiment, the population of CART cells can include a first cell expressing a CD19 CAR and a second cell expressing a CD10 CAR.

CD34 Inhibitors

The CD34 inhibitor may be, e.g., a small molecule, antibody, or fragment thereof (e.g., a monospecific or bispecific antibody or fragment thereof); a recombinant protein, e.g., fusion protein, that binds to CD34; inhibitory nucleic acid; or a cell expressing a CD34 CAR, e.g., a CD34 CART.

In an embodiment, the CD34 inhibitor comprises a monoclonal antibody or fragment thereof that targets CD34 or an immunoliposome comprising an anti-CD34 monoclonal antibody or fragment thereof.

In one embodiment, the CD34 inhibitor is an anti-CD34 CAR-expressing cell, e.g., CD34 CART or CD34 CAR-expressing NK cell.

In one embodiment, the present disclosure provides a population of CAR-expressing cells, e.g., CART cells, comprising a mixture of cells expressing CD19 CARs and CD34 CARs. For example, in one embodiment, the population of CART cells can include a first cell expressing a CD19 CAR and a second cell expressing a CD34 CAR.

FLT-3 Inhibitors

The FLT-3 inhibitor may be, e.g., a small molecule, antibody, or fragment thereof (e.g., a monospecific or bispecific antibody or fragment thereof); a recombinant protein, e.g., fusion protein, that binds to FLT-3; inhibitory nucleic acid; or a cell expressing a FLT-3 CAR, e.g., a FLT-3 CART.

In some embodiments, the FLT-3 inhibitor comprises a small molecule, such as quizartinib (Ambit Biosciences), midostaurin (Technische Universitat Dresden), sorafenib (Bayer and Onyx Pharmaceuticals), sunitinib (Pfizer), lestaurtinib (Cephalon), or a pharmaceutically acceptable salt or derivative thereof.

In one embodiment, the FLT-3 inhibitor is an anti-FLT-3 CAR expressing cell, e.g., FLT-3 CART or FLT-3 CAR-expressing NK cell.

In one embodiment, the present disclosure provides a population of CAR-expressing cells, e.g., CART cells, comprising a mixture of cells expressing CD19 CARs and FLT-3 CARs. For example, in one embodiment, the population of CART cells can include a first cell expressing a CD19 CAR and a second cell expressing a FLT-3 CAR.

CD79b Inhibitors

In certain embodiments, the CD19 CAR-expressing cell is administered with a CD79b inhibitor. The CD79b inhibitor can be, e.g., a small molecule, antibody, or fragment thereof (e.g., a monospecific or bispecific antibody or fragment thereof); a recombinant protein, e.g., fusion protein, that binds to CD79b; inhibitory nucleic acid; or a cell expressing a CD79b CAR, e.g., a CD79b CAR-expressing T cell or NK cell. In one embodiment, the CD79b inhibitor is an anti-CD79b CAR expressing cell, e.g., CD79b CART or CD79b CAR-expressing NK cell. Exemplary CD79b inhibitors are described in more detail below.

In an embodiment, the present disclosure provides a population of CAR-expressing cells, e.g., CART cells or CAR-expressing NK cells, comprising a mixture of cells expressing CD19 CARs and CD79b CARs. For example, in one embodiment, the population of CAR-expressing cells includes a first cell expressing a CD19 CAR and a second cell expressing a CD79b CAR.

CD179b Inhibitors

In certain embodiments, the CD19 CAR-expressing cell is administered with a CD179b inhibitor. The CD179b inhibitor can be, e.g., a small molecule, antibody, or fragment thereof (e.g., a monospecific or bispecific antibody or fragment thereof); a recombinant protein, e.g., fusion protein, that binds to CD179b; inhibitory nucleic acid; or a cell expressing a CD179b CAR, e.g., a CD179b CAR-expressing T cell or NK cell. In one embodiment, the CD79b inhibitor is an anti-CD179b CAR expressing cell, e.g., CD179b CART or CD179b CAR-expressing NK cell. Exemplary CD179b inhibitors are described in more detail below.

In an embodiment, the present disclosure provides a population of CAR-expressing cells, e.g., CART cells or CAR-expressing NK cells, comprising a mixture of cells expressing CD19 CARs and CD179b CARs. For example, in one embodiment, the population of CAR-expressing cells includes a first cell expressing a CD20 CAR and a second cell expressing a CD179b CAR.

C79a Inhibitors

In certain embodiments, the CD19 CAR-expressing cell is administered with a CD79a inhibitor. The CD79a inhibitor can be, e.g., a small molecule, antibody, or fragment thereof (e.g., a monospecific or bispecific antibody or fragment thereof); a recombinant protein, e.g., fusion protein, that binds to CD79a; inhibitory nucleic acid; or a cell expressing a CD79a CAR, e.g., a CD79a CAR-expressing T cell or NK cell. In one embodiment, the CD79a inhibitor is an anti-CD79a CAR expressing cell, e.g., CD79a CART or CD79a CAR-expressing NK cell. Exemplary CD79a inhibitors are described in more detail below.

In an embodiment, the present disclosure provides a population of CAR-expressing cells, e.g., CART cells or CAR-expressing NK cells, comprising a mixture of cells expressing CD19 CARs and CD79a CARs. For example, in one embodiment, the population of CAR-expressing cells includes a first cell expressing a CD19 CAR and a second cell expressing a CD79a CAR.

Car Molecules

The binding domains described herein (e.g., binding domains against one or more of CD10, CD20, CD22, CD34, CD123, FLT-3, ROR1, CD79b, CD179b, or CD79a) may further comprise one or more additional amino acid sequences.

In one embodiment, the CAR molecule comprises a transmembrane domain of a protein selected from the group consisting of the alpha, beta or zeta chain of the T-cell receptor, CD28, CD3 epsilon, CD45, CD4, CD5, CD8, CD9, CD16, CD22, CD33, CD37, CD64, CD80, CD86, CD134, CD137 and CD154. In one embodiment, the transmembrane domain comprises a sequence of SEQ ID NO: 15. In one embodiment, the transmembrane domain comprises an amino acid sequence having at least one, two or three modifications (e.g., substitutions) but not more than 20, 10 or 5 modifications (e.g., substitutions) of an amino acid sequence of SEQ ID NO: 15, or a sequence with 95-99% identity to an amino acid sequence of SEQ ID NO: 15.

In one embodiment, the binding domain is connected to the transmembrane domain by a hinge region, e.g., a hinge region described herein. In one embodiment, the encoded hinge region comprises SEQ ID NO:14 or SEQ ID NO:45, or a sequence with 95-99% identity thereof.

In one embodiment, the CAR molecule further comprises a sequence encoding a costimulatory domain, e.g., a costimulatory domain described herein. In one embodiment, the costimulatory domain comprises a functional signaling domain of a protein selected from the group consisting of OX40, CD2, CD27, CD28, CDS, ICAM-1, LFA-1 (CD11a/CD18), ICOS (CD278), and 4-1BB (CD137). In one embodiment, the costimulatory domain comprises a sequence of SEQ ID NO: 16. In one embodiment, the costimulatory domain comprises a sequence of SEQ ID NO:51. In one embodiment, the costimulatory domain comprises an amino acid sequence having at least one, two or three modifications (e.g., substitutions) but not more than 20, 10 or 5 modifications (e.g., substitutions) of an amino acid sequence of SEQ ID NO: 16 or SEQ ID NO:51, or a sequence with 95-99% identity to an amino acid sequence of SEQ ID NO: 16 or SEQ ID NO:51. In one embodiment, the costimulatory domain comprises a functional signaling domain of a protein selected from the group consisting of MHC class I molecule, TNF receptor proteins, Immunoglobulin-like proteins, cytokine receptors, integrins, signaling lymphocytic activation molecules (SLAM proteins), activating NK cell receptors, BTLA, a Toll ligand receptor, OX40, CD2, CD7, CD27, CD28, CD30, CD40, CDS, ICAM-1, LFA-1 (CD11a/CD18), 4-1BB (CD137), B7-H3, CDS, ICAM-1, ICOS (CD278), GITR, BAFFR, LIGHT, HVEM (LIGHTR), KIRDS2, SLAMF7, NKp80 (KLRF1), NKp44, NKp30, NKp46, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, CD19a, and a ligand that specifically binds with CD83. In embodiments, the costimulatory domain comprises 4-1BB, CD27, CD28, or ICOS.

In one embodiment, the CAR molecule further comprises a sequence encoding an intracellular signaling domain, e.g., an intracellular signaling domain described herein. In one embodiment, the intracellular signaling domain comprises a functional signaling domain of 4-1BB and/or a functional signaling domain of CD3 zeta. In one embodiment, the intracellular signaling domain comprises the sequence of SEQ ID NO: 16 and/or the sequence of SEQ ID NO:17. In one embodiment, the intracellular signaling domain comprises the sequence of SEQ ID NO:16 and/or the sequence of SEQ ID NO:43. In one embodiment, the intracellular signaling domain comprises a functional signaling domain of CD27 and/or a functional signaling domain of CD3 zeta. In one embodiment, the intracellular signaling domain comprises the sequence of SEQ ID NO: 51 and/or the sequence of SEQ ID NO:17. In one embodiment, the intracellular signaling domain comprises the sequence of SEQ ID NO:51 and/or the sequence of SEQ ID NO:43. In one embodiment, the intracellular signaling domain comprises an amino acid sequence having at least one, two or three modifications (e.g., substitutions) but not more than 20, 10 or 5 modifications (e.g., substitutions) of an amino acid sequence of SEQ ID NO:16 or SEQ ID NO:51 and/or an amino acid sequence of SEQ ID NO:17 or SEQ ID NO:43, or a sequence with 95-99% identity to an amino acid sequence of SEQ ID NO:16 or SEQ ID NO:51 and/or an amino acid sequence of SEQ ID NO:17 or SEQ ID NO:43. In one embodiment, the intracellular signaling domain comprises the sequence of SEQ ID NO:16 or SEQ ID NO:51 and the sequence of SEQ ID NO: 17 or SEQ ID NO:43, wherein the sequences comprising the intracellular signaling domain are expressed in the same frame and as a single polypeptide chain.

In one embodiment, the CAR molecule further comprises a leader sequence, e.g., a leader sequence described herein. In one embodiment, the leader sequence comprises an amino acid sequence of SEQ ID NO: 13, or a sequence with 95-99% identity to an amino acid sequence of SEQ ID NO:13.

In one aspect, the CAR (e.g., a CD19 CAR, a ROR1 CAR, a CD20 CAR, a CD22 CAR, a CD123 CAR, a CD10 CAR, a CD34 CAR, a FLT-3 CAR, a CD79b CAR, a CD179b CAR, or a CD79a CAR) comprises an optional leader sequence (e.g., an optional leader sequence described herein), an extracellular antigen binding domain, a hinge (e.g., hinge described herein), a transmembrane domain (e.g., transmembrane domain described herein), and an intracellular stimulatory domain (e.g., intracellular stimulatory domain described herein). In one aspect an exemplary CAR construct comprises an optional leader sequence (e.g., a leader sequence described herein), an extracellular antigen binding domain, a hinge, a transmembrane domain, an intracellular costimulatory domain (e.g., an intracellular costimulatory domain described herein) and an intracellular stimulatory domain.

Bispecific Antibodies

A bispecific antibody molecule (which can be, e.g., administered alone or as a portion of a CAR) can comprise two VH regions and two VL regions. In some embodiments, the upstream antibody or portion thereof (e.g. scFv) is arranged with its VH ($VH_1$) upstream of its VL ($VL_1$) and the downstream antibody or portion thereof (e.g. scFv) is arranged with its VL ($VL_2$) upstream of its VH ($VH_2$), such that the overall bispecific antibody molecule has the arrangement $VH_1$-$VL_1$-$VL_2$-$VH_2$. In other embodiments, the upstream antibody or portion thereof (e.g. scFv) is arranged with its VL ($VL_1$) upstream of its VH ($VH_1$) and the downstream antibody or portion thereof (e.g. scFv) is arranged with its VH ($VH_2$) upstream of its VL ($VL_2$), such that the overall bispecific antibody molecule has the arrangement $VL_1$-$VH_1$-$VH_2$—$VL_2$.

Bispecific CD22/CD19 Inhibitors

In an embodiment, the B-cell inhibitor comprises a bispecific CAR19/CAR22 antibody molecule. For instance, in some embodiments, the B-cell inhibitor comprises one or more amino acid sequences of Table 28, or a sequence having 95-99% identity thereto. Further provided are nucleic acids according to Table 28, or a sequence having 95-99% identity thereto. In an embodiment, the B-cell inhibitor comprises a CD19-specific antibody molecule of Table 2 or 3 (or a sequence having 95-99% identity thereto) and a CD22-specific antibody molecule of Table 6A or 6B (or a sequence having 95-99% identity thereto). In an embodiment, the B-cell inhibitor comprises a CD19-specific antibody molecule having one or more CDRs of Table 4 or 5 (or a sequence having 1, 2, 3, 4, 5, or 6 alterations e.g., substitutions thereto) and a CD22-specific antibody molecule having CDRs of Table 7A, 7B, 7C, 8A or 8B (or a sequence having 1, 2, 3, 4, 5, or 6 alterations e.g., substitutions thereto).

mTor Inhibitors

In one embodiment, the cells expressing a CAR molecule, e.g., a CD19 CAR molecule, a CD20 CAR molecule, or a CD22 CAR molecule e.g., a CAR molecule described herein, optionally administered in combination with a B-cell inhibitor, are co-administered with a low, immune enhancing dose of an mTOR inhibitor. While not wishing to be bound by theory, it is believed that treatment with a low, immune enhancing, dose (e.g., a dose that is insufficient to completely suppress the immune system but sufficient to improve immune function) is accompanied by a decrease in PD-1 positive T cells or an increase in PD-1 negative cells. PD-1 positive T cells, but not PD-1 negative T cells, can be exhausted by engagement with cells which express a PD-1 ligand, e.g., PD-L1 or PD-L2.

In an embodiment this approach can be used to optimize the performance of CAR cells described herein in the subject. While not wishing to be bound by theory, it is believed that, in an embodiment, the performance of endogenous, non-modified immune effector cells, e.g., T cells, is improved. While not wishing to be bound by theory, it is believed that, in an embodiment, the performance of a CAR expressing cell is improved. In other embodiments, cells, e.g., T cells, which have, or will be engineered to express a CAR, can be treated ex vivo by contact with an amount of an mTOR inhibitor that increases the number of PD1 negative immune effector cells, e.g., T cells or increases the ratio of PD1 negative immune effector cells, e.g., T cells/PD1 positive immune effector cells, e.g., T cells.

In an embodiment, administration of a low, immune enhancing, dose of an mTOR inhibitor, e.g., an allosteric inhibitor, e.g., RAD001, or a catalytic inhibitor, is initiated prior to administration of an CAR expressing cell described herein, e.g., T cells. In an embodiment, the CAR cells are administered after a sufficient time, or sufficient dosing, of an mTOR inhibitor, such that the level of PD1 negative immune effector cells, e.g., T cells, or the ratio of PD1 negative immune effector cells, e.g., T cells/PD1 positive immune effector cells, e.g., T cells, has been, at least transiently, increased.

In an embodiment, the cell, e.g., T cell, to be engineered to express a CAR, is harvested after a sufficient time, or after sufficient dosing of the low, immune enhancing, dose of an mTOR inhibitor, such that the level of PD1 negative immune effector cells, e.g., T cells, or the ratio of PD1 negative immune effector cells, e.g., T cells/PD1 positive immune effector cells, e.g., T cells, in the subject or harvested from the subject has been, at least transiently, increased.

Additional features or embodiments of the compositions or methods described herein include one or more of the following:

In embodiments, the B-cell inhibitor comprises an inhibitor of one or more of CD10, CD20, CD22, CD34, CD123, FLT-3, or ROR1. In embodiments, the B-cell inhibitor comprises an effective number of one or more cells that express a CAR molecule that binds one or more of CD10, CD20, CD22, CD34, CD123, FLT-3, or ROR1.

In embodiments, the one or more cells that express a CAR molecule that binds CD19 are administered concurrently with, before, or after the one or more B-cell inhibitors.

In embodiments, the subject has or is identified as having a difference, e.g., a statistically significant difference, between a determined level compared to a reference level of one or more markers listed in Table 29 in a biological sample.

In embodiments, the subject has or is identified as having a difference between a determined characteristic compared to a reference characteristic, in a characteristic of CD19, e.g., a mutation causing a frameshift or a premature stop codon or both, in a biological sample.

In embodiments, the subject has or is identified as having a difference, e.g., a statistically significant difference, between a determined level compared to a reference level of Treg cells in a biological sample.

In an embodiment, the method comprises administering to the subject a therapeutically effective dose of a chimeric antigen receptor (CAR) therapy, e.g., a CAR therapy as described herein, e.g., a therapy comprising a CD19 CAR-expressing cell and optionally one or more B-cell inhibitor, and if the subject is identified as having a difference, e.g., a statistically significant difference, between a determined level compared to a reference level, or a determined characteristic compared to a reference characteristic, in one or more of (i) a level or activity of one or more markers listed in Table 29; (ii) a characteristic of CD19, e.g., a mutation, e.g., a mutation causing a frameshift or a premature stop codon or both, or (iii) a level of $T_{REG}$ cells in a biological sample. In an embodiment, the method comprises determining if the subject has a difference, e.g., a statistically significant difference, between a determined level compared to a reference level, or a determined characteristic compared to a reference characteristic, in one or more of (i) a level of one or more markers listed in Table 29; (ii) a characteristic of CD19, e.g., a mutation, e.g., a mutation causing a frameshift or a premature stop codon or both, or (iii) a level or activity of $T_{REG}$ cells in a biological sample, and administering to the subject a therapeutically effective dose of a chimeric antigen receptor (CAR) therapy, e.g., a CAR therapy as described herein, e.g., a therapy comprising a CD19 CAR-expressing cell and optionally one or more B-cell inhibitor. In an embodiment, the method comprises determining if the subject has a difference, e.g., a statistically significant difference, between a determined level compared to a reference level, or a determined characteristic compared to a reference characteristic, in one or more of (i) a level of one or more markers listed in Table 29; (ii) a characteristic of CD19, e.g., a mutation, e.g., a mutation causing a frameshift or a premature stop codon or both, or (iii) a level or activity of $T_{REG}$ cells in a biological sample, and administering to the subject a therapeutically effective dose of a chimeric antigen receptor (CAR) therapy, e.g., a CAR therapy as described herein, e.g., a therapy comprising a CD19 CAR-expressing cell and optionally one or more B-cell inhibitor. In an embodiment, the method comprises administering to a subject a therapeutically effective dose of a chimeric antigen receptor (CAR) therapy, e.g., a CAR therapy as described herein, e.g., a therapy comprising a CD19 CAR-expressing cell, determining if the subject has a difference, e.g., a statistically significant difference, between a determined level compared to a reference level, or a determined characteristic compared to a reference characteristic, in one or more of (i) a level of one or more markers listed in Table 29; (ii) a characteristic of CD19, e.g., a mutation, e.g., a mutation causing a frameshift or a premature stop codon or both, or (iii) a level or activity of $T_{REG}$ cells in a biological sample, and if the difference is present, administering to a subject a therapeutically effective dose of one or more B-cell inhibitor.

In embodiments, the subject has or is identified as having an increase, e.g., a statistically significant increase, between a determined level and to a reference level of Treg cells in a biological sample.

In embodiments, the subject has relapsed or is identified as having relapsed after treatment with the one or more cells that express a CAR molecule that binds CD19, e.g., a CD19 CAR.

In embodiments, the B-cell inhibitor comprises an effective number of one or more cells that express: a CAR molecule that binds CD10, e.g., a CD10 CAR as described herein; a CAR molecule that binds CD20, e.g., a CD20 CAR as described herein; a CAR molecule that binds CD22, e.g., a CD22 CAR as described herein; a CAR molecule that binds CD34, e.g., a CD34 CAR as described herein; a CAR molecule that binds CD123, e.g., a CD123 CAR as described herein; a CAR molecule that binds FLT-3, e.g., a FLT-3 CAR as described herein; or a CAR molecule that binds ROR1, e.g., an ROR1 CAR as described herein.

In embodiments, the CD19 inhibitor comprises an antibody or antibody fragment which includes a CD19 binding domain, a transmembrane domain, and an intracellular signaling domain comprising a stimulatory domain, and wherein said CD19 binding domain comprises one or more of (e.g., all three of) light chain complementary determining region 1 (LC CDR1), light chain complementary determining region 2 (LC CDR2), and light chain complementary determining region 3 (LC CDR3) of any CD19 light chain binding domain amino acid sequence listed in Tables 2 or 3, and one or more of (e.g., all three of) heavy chain complementary determining region 1 (HC CDR1), heavy chain complementary determining region 2 (HC CDR2), and heavy chain complementary determining region 3 (HC CDR3) of any CD19 heavy chain binding domain amino acid sequence listed in Tables 2 or 3.

In embodiments, a CD19 CAR comprises light chain variable region listed in Tables 2 or 3 and any heavy chain variable region listed Tables 2 or 3.

In embodiments, the CD19 inhibitor comprises a CD19 binding domain which comprises a sequence selected from a group consisting of SEQ ID NO:1, SEQ ID NO:2, SEQ ID NO:3, SEQ ID NO: 4, SEQ ID NO:5, SEQ ID NO:6, SEQ ID NO:7, SEQ ID NO:8, SEQ ID NO:9, SEQ ID NO:10, SEQ ID NO:11 and SEQ ID NO:12, or a sequence with 95-99% identity thereof. In embodiments, the CD19 CAR comprises a polypeptide of SEQ ID NO:58.

In embodiments, the B-cell inhibitor comprises a CD20 CAR which comprises an antibody or antibody fragment which includes a CD20 binding domain, a transmembrane domain, and an intracellular signaling domain comprising a stimulatory domain, and wherein said CD20 binding domain comprises one or more of light chain complementary determining region 1 (LC CDR1), light chain complementary determining region 2 (LC CDR2), and light chain complementary determining region 3 (LC CDR3) of any CD20 light chain binding domain amino acid sequence listed in Table 13, and one or more of heavy chain complementary determining region 1 (HC CDR1), heavy chain complementary determining region 2 (HC CDR2), and heavy chain complementary determining region 3 (HC CDR3) of any CD20 heavy chain binding domain amino acid sequence listed in Table 12A or 12B.

In embodiments, the B-cell inhibitor comprises a CD22 CAR which comprises an antibody or antibody fragment which includes a CD22 binding domain, a transmembrane domain, and an intracellular signaling domain comprising a stimulatory domain, and wherein said CD22 binding domain comprises one or more of light chain complementary determining region 1 (LC CDR1), light chain complementary determining region 2 (LC CDR2), and light chain complementary determining region 3 (LC CDR3) of any CD22 light chain binding domain amino acid sequence listed in Table 8A, 8B, 10A and/or 10B, and one or more of heavy chain complementary determining region 1 (HC CDR1), heavy chain complementary determining region 2 (HC CDR2), and heavy chain complementary determining region 3 (HC CDR3) of any CD22 heavy chain binding domain amino acid sequence listed in Table 7A, 7B, 7C, 9A, and/or 9B.

In embodiments, the CD22 CAR comprises any light chain variable region listed in Table 10A or 10B. In embodiments, the CD22 CAR comprises any heavy chain variable region listed in Table 9A or 9B. In embodiments, the CD22 CAR comprises any light chain variable region listed in Table 10A or 10B and any heavy chain variable region listed Table 9A or 9B.

In embodiments, the B-cell inhibitor comprises a CAR which comprises an antibody or antibody fragment which includes an antigen binding domain, a transmembrane domain, and an intracellular signaling domain comprising a stimulatory domain, and wherein said antigen binding domain comprises one or more of (e.g., all of) light chain complementary determining region 1 (LC CDR1), light chain complementary determining region 2 (LC CDR2), and light chain complementary determining region 3 (LC CDR3), and one or more of (e.g., all of) heavy chain complementary determining region 1 (HC CDR1), heavy chain complementary determining region 2 (HC CDR2), and heavy chain complementary determining region 3 (HC CDR3).

In embodiments, the B-cell inhibitor comprises a CAR which comprises a scFv. In embodiments, the B-cell inhibitor comprises a CAR which comprises a transmembrane domain that comprises a transmembrane domain of a protein selected from the group consisting of the alpha, beta or zeta chain of the T-cell receptor, CD28, CD3 epsilon, CD45, CD4, CD5, CD8, CD9, CD16, CD22, CD33, CD37, CD64, CD80, CD86, CD134, CD137 and CD154. In embodiments, the antigen binding domain is connected to the transmembrane domain by a hinge region. In embodiments, the hinge region comprises SEQ ID NO:14, or a sequence with 95-99% identity thereof. In embodiments, the costimulatory domain is a functional signaling domain obtained from a protein selected from the group consisting of OX40, CD2, CD27, CD28, CDS, ICAM-1, LFA-1 (CD11a/CD18), ICOS (CD278), and 4-1BB (CD137). In embodiments, the costimulatory domain is a functional signaling domain obtained from a protein selected from the group consisting of MHC class I molecule, TNF receptor proteins, Immunoglobulin-like proteins, cytokine receptors, integrins, signaling lymphocytic activation molecules (SLAM proteins), activating NK cell receptors, BTLA, a Toll ligand receptor, OX40, CD2, CD7, CD27, CD28, CD30, CD40, CDS, ICAM-1, LFA-1 (CD11a/CD18), 4-1BB (CD137), B7-H3, CDS, ICAM-1, ICOS (CD278), GITR, BAFFR, LIGHT, HVEM (LIGHTR), KIRDS2, SLAMF7, NKp80 (KLRF1), NKp44, NKp30, NKp46, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, CD19a, and a ligand that specifically binds with CD83. In embodiments, the costimulatory domain comprises a sequence of SEQ ID NO:16 or SEQ ID NO:51. In embodiments, the intracellular signaling domain comprises a functional signaling domain of 4-1BB and/or a functional signaling domain of CD3 zeta.

In embodiments, the intracellular signaling domain comprises the sequence of SEQ ID NO: 16 and/or the sequence of SEQ ID NO:17 or SEQ ID NO:43. In embodiments, the CAR further comprises a leader sequence. In embodiments, the leader sequence comprises SEQ ID NO: 13.

In embodiments, the cells that express the CAR molecule comprise T cells or NK cells.

In embodiments, the disease associated with CD19 expression is selected from a proliferative disease such as a cancer or malignancy or a precancerous condition such as a myelodysplasia, a myelodysplastic syndrome or a preleukemia, or is a non-cancer related indication associated with expression of CD19. In embodiments, the disease is one or more of a hematologic cancer, acute leukemia, B-cell acute lymphoid leukemia (BALL), T-cell acute lymphoid leukemia (TALL), small lymphocytic leukemia (SLL), acute lymphoid leukemia (ALL); chronic leukemia, chronic myelogenous leukemia (CML), or chronic lymphocytic leukemia (CLL).

In embodiments, the method further comprises administering an agent that increases the efficacy of a cell expressing a CAR molecule. In embodiments, the method further comprises administering an agent that ameliorates one or more side effects associated with administration of a cell expressing a CAR molecule. In embodiments, the cells expressing a CAR molecule are administered in combination with an agent that treats the disease associated with CD19.

In embodiments, in accordance with a method described herein, e.g., a method of providing anti-tumor immunity to a mammal, or method of treating a mammal, a mammal is a non-responder, partial responder, or complete responder to a previously administered cancer therapy, e.g., a CD19 CAR therapy or a cancer therapy other than a CD19 CAR-expressing cell. In embodiments, the mammal is a non-relapser, partial relapse, or complete relapse to a previously administered cancer therapy, e.g., a CD19 CAR therapy or a cancer therapy other than a CD19 CAR-expressing cell. In embodiments, the mammal comprises a CD19-negative cancer cell or a CD19-positive cancer cell, optionally wherein the mammal further comprises a CD22-positive, CD123-positive, FLT-3-positive, ROR-1-positive, CD79b-positive, CD179b-positive, CD79a-positive, CD10-positive, CD34-positive, and/or CD20-positive cancer cell. In embodiments, the mammal has a relapsed ALL cancer. In embodiments, the mammal was previously administered a CD19 CAR-expressing cell and is refractory to CD19 CAR treatment.

In embodiments, the agent is an mTOR inhibitor and the subject is administered a low, immune enhancing, dose of an mTOR inhibitor, e.g., RAD001 or rapamycin. In embodiments, the mTOR inhibitor is a RAD001. In embodiments, the dose comprises an allosteric and a catalytic mTOR inhibitor. In embodiments, the mTOR inhibitor is administered for an amount of time sufficient to decrease the proportion of PD-1 positive T cells, increase the proportion of PD-1 negative T cells, or increase the ratio of PD-1 negative T cells/PD-1 positive T cells, in the peripheral blood of the subject, or in a preparation of T cells isolated from the subject.

In embodiments, the immune effector cell, e.g., T cell, to be engineered to express a CAR, is harvested after a sufficient time, or after sufficient dosing of the low, immune enhancing, dose of an mTOR inhibitor, such that the level of PD1 negative immune effector cells, e.g., T cells, or the ratio of PD1 negative immune effector cells, e.g., T cells/PD1 positive immune effector cells, e.g., T cells, in the subject or harvested from the subject has been, at least transiently, increased. In embodiments, the dose of an mTOR inhibitor is associated with mTOR inhibition of at least 5 but no more than 90%, e.g., as measured by p70 S6 K inhibition. In embodiments, the dose of an mTOR inhibitor is associated with mTOR inhibition of at least 10% but no more than 40%, e.g., as measured by p70 S6 K inhibition.

In an embodiment, the method further comprises administering a checkpoint inhibitor. In embodiments, the subject receives a pre-treatment of with an agent, e.g., an mTOR inhibitor, and/or a checkpoint inhibitor, prior to the initiation of a CART therapy. In embodiments, the subject receives concurrent treatment with an agent, e.g., an mTOR inhibitor, and/or a checkpoint inhibitor. In embodiments, the subject receives treatment with an agent, e.g., an mTOR inhibitor, and/or a checkpoint inhibitor, post-CART therapy.

In embodiments, the determined level or determined characteristic is acquired before, at the same time, or during a course of CART therapy.

In embodiments, the method comprises assaying a gene signature that indicates whether the subject is likely to relapse, or has relapsed. In embodiments, the method comprises assaying a gene signature in a subject prior to treatment with a CAR-expressing cell, e.g., CART treatment (e.g., a CART19 treatment, e.g., CTL019 therapy) that predicts relapse to CAR treatment. In embodiments, the level of one or more markers is the level of at least 2, 3, 4, 5, 6, 7, 8, 9, or 10 markers listed in Table 29. In embodiments, the level of the marker comprises an mRNA level or a level of a soluble protein.

In embodiments, the characteristic of CD19 is a mutation in exon 2, e.g., a mutation causing a frameshift or a premature stop codon or both. In embodiments, the level of $T_{REG}$ cells is determined by staining a sample for a marker expressed by $T_{REG}$ cells. In embodiments, the level of $T_{REG}$ cells is the level of Treg cells in a relevant location in the subject's body, e.g., in a cancer microenvironment.

In embodiments, the method further comprises decreasing the $T_{REG}$ signature in the subject prior to apheresis. In embodiments, the method further comprises decreasing the $T_{REG}$ signature in the subject, e.g., by administering cyclophosphamide, an anti-GITR antibody, or both to the subject. In embodiments, the method comprises pre-treating a subject with cyclophosphamide, an anti-GITR antibody, or both, prior to collection of cells for CAR-expressing cell product manufacturing. In embodiments, the method further comprises obtaining a sample from the subject, wherein the sample comprises a cellular fraction (e.g., which comprises blood), a tissue fraction, an apheresis sample, or a bone marrow sample.

In embodiments, the cell expresses an inhibitory molecule that comprises a first polypeptide that comprises at least a portion of an inhibitory molecule, associated with a second polypeptide that comprises a positive signal from an intracellular signaling domain. In embodiments, the inhibitory molecule comprise first polypeptide that comprises at least a portion of PD1 and a second polypeptide comprising a costimulatory domain and primary signaling domain.

In embodiments, the method comprises assaying a gene signature that indicates whether a subject treated with the cell is likely to relapse, or has relapsed. In embodiments, the method comprises assaying the gene signature in the cell prior to infusion into the subject. In embodiments, the method further comprises decreasing the $T_{REG}$ signature of a population of cells comprising the transduced cell. In embodiments, decreasing the $T_{REG}$ signature comprises performing CD25-depletion on the population of cells.

In embodiments, the subject is a mammal, e.g., a human.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein (e.g., sequence database reference numbers) are incorporated by reference in their entirety. For example, all GenBank, Unigene, and Entrez sequences referred to herein, e.g., in any Table herein, are incorporated by reference. Unless otherwise specified, the sequence accession numbers specified herein, including in any Table herein, refer to the database entries current as of Apr. 8, 2015. When one gene or protein references a plurality of sequence accession numbers, all of the sequence variants are encompassed.

In addition, the materials, methods, and examples are illustrative only and not intended to be limiting.

Headings, sub-headings or numbered or lettered elements, e.g., (a), (b), (i) etc, are presented merely for ease of reading. The use of headings or numbered or lettered elements in this document does not require the steps or elements be performed in alphabetical order or that the steps or elements are necessarily discrete from one another.

Other features, objects, and advantages of the invention will be apparent from the description and drawings, and from the claims.

BRIEF DESCRIPTION OF THE DRAWINGS

FIGS. 4A and 4B are representative flow cytometry profiles demonstrating the distribution of PD-1 and CAR19 expression on CD4+ T cells from subjects that are complete responders (CR) or non-responders (NR) to CART therapy. FIG. 4C is a graph showing the percent of PD1 cells in the CD4+ T cell population from groups of subjects with different responses to CART therapy. FIG. 4D is a graph showing the percent of PD1 cells in the CD8+ T cell population from groups of subjects with different responses to CART therapy.

FIG. 15A shows CAR T-cell activation in the presence of CD20 expressing target cell line, Daudi. FIG. 15B shows CAR T-cell activation in the presence of CD20 expressing target cell line, Raji. FIG. 15C shows CAR T-cell activation in the presence of a non CD20 expressing negative control, K562.

In FIG. 18A, CAR-expressing JNL cells were mixed with the Daudi CD22 expressing target cell line at the indicated E:T ratios. In FIG. 18B, CAR-expressing JNL cells were mixed with the Raji CD22 expressing target cell line at the indicated E:T ratios. In FIG. 18C, CAR-expressing JNL cells were mixed with the negative control K562 cell line at the indicated E:T ratios.

FIGS. 39A, 39B, 39C and 39D are a graph showing CD22 RNA-expression data from GeneAtlas U133A. CD22 expression was observed at high level in B-cells, tonsil and lymph node. B-lymphoblast and leukemia/lymphoma cell lines were also highly positive.

FIG. 43A shows a graphical representation of CD123 CAR expression in primary T-cells. Percentage of cells transduced (expressing the anti-CD123 CAR on the cell surface) and their relative fluorescence intensity of expression were determined by flow cytometric analysis on a BD LSR-Fortessa or BD-FACSCanto using Protein L as a detection reagent. Gating histogram plots of relative fluorescent intensity from that FACS for signal above unstained cells shows the percentage of transduced T cells. Transduction resulted in a range of CAR positive cells from 12-42%. FIG. 43B shows a graphical representation of CD123-CART-mediated cell killing. T cell killing was directed towards CD123-expressing MOLM13 acute myelogenous leukemia cells stably expressing luciferase. Untransduced T cells were used to determine non-specific background killing levels. The cytolytic activities of CART-CD123 were measured over a range of effector:target cell ratios of 4:1 and 2-fold downward dilutions of T cells where effectors were defined as T cells expressing the anti-CD123 chimeric receptor. Assays were initiated by mixing an appropriate number of T cells with a constant number of targets cells. After 20 hours luciferase signal was measured using the Bright-Glo™ Luciferase Assay on the EnVision instrument.

FIG. 44A shows transduction efficiency of T cells with 1172 and 1176. FIG. 44B shows transduction efficiency of T cells with CD123 CARs 2-4.

FIG. 49A shows expression of CD123 compared to CD19 in 42 relapsing/refractory ALL samples. FIG. 49B shows CD123 and CD19 co-expression in B-ALL blasts. Gated on blasts (SSC low, singlet, live, CD45dim). FIG. 49C shows the gating strategy for the leukemia stem cell (LSC). CD123 is highly expressed in this subset. FIG. 49D shows CD123 and CD19 co-expression and results from FISH analysis. FIGS. 49E and 49F show the comparison of CD19 and CD123 expression at baseline or after relapse.

FIG. 50A shows CD19 and CD123 expression; FIG. 50B shows a CD107a degranulation assay; FIG. 50C shows the capability for targeted cell killing; FIGS. 50D and 50E shows proliferation capacity; FIG. 50F shows cytokine production for the indicated cytokines.

FIG. 51A shows the tumor burden represented by bioluminescent imaging; FIG. 51B shows the overall survival curve of mice receiving CART therapy; and FIG. 51C shows the expansion of CART123 cells in the peripheral blood.

FIG. 52A shows the experimental schema; FIG. 52B shows disease progression as represented by bioluminescent imaging in baseline and relapse disease with respect to CD19 expression (top graph) and in response to treatment with CART19 therapy (bottom graph); FIG. 52C shows bioluminescent images of mice administered untransduced T cells or CART19 cells; FIG. 52D shows the experimental schema for treating with CART19 or CART123; FIG. 52E shows the disease progression; and FIG. 52F shows the overall survival of the treated mice.

FIG. 53A shows the experimental schema; FIG. 53B shows representative multiphoton XY plane images of CART19 cells and CART123 cells interacting with ALL tumor engineered to express either CD19 and CD123 or CD123 alone (motile cells are indicated in dashed circles, non-motile cells are indicated with the arrows); and FIG. 53C is a graphic representation of the microscopy images.

FIG. 54A shows the experimental schema; FIG. 54B shows the disease progression (tumor burden as represented by BLI) of mice treated with untransduced T cells (top graph), CART19 (middle graph), or the combination of CART19 and CART123 (bottom graph); and FIG. 54C shows the overall survival from this experiment.

FIG. 56A shows expression of various markers CD19, CD123, CD10, CD34, and CD20; and FIG. 56B shows the gating strategy for sorting CD19-CD123+ cells.

FIG. 57A shows the expression of CD19 and CD123 on the NALM6 cells; FIG. 57B shows the tumor burden (as represented by BLI) in response to CART19 or CART123 therapy; FIG. 57C shows the overall survival of mice administered CART19 or CART123; and FIG. 57D shows the overall survival of mice administered varying doses of CART123.

FIG. 58A shows the expression of CD123 in CD19 negative relapse disease; and FIG. 58B shows the degranulation assay of CART19 or CART123 cells when cultured with baseline or relapse cells in vitro.

FIG. 61A shows day 0 PK following the first dose of RAD001. FIG. 61B shows Day 14 PK following the final RAD001 dose. Diamonds denote the 10 mg/kg dose of RAD001; squares denote the 1 mg/kg dose of RAD001; triangles denote the 3 mg/kg dose of RAD001; and x's denote the 10 mg/kg dose of RAD001.

FIG. 62A shows CD4+ CAR T cells; FIG. 62B shows CD8+ CAR T cells. Circles denote PBS; squares denote huCTL019; triangles denote huCTL019 with 3 mg/kg RAD001; inverted triangles denote huCTL019 with 0.3 mg/kg RAD001; diamonds denote huCTL019 with 0.03 mg/kg RAD001; and circles denote huCTL019 with 0.003 mg/kg RAD001.

DETAILED DESCRIPTION

Definitions

Figure 1A:
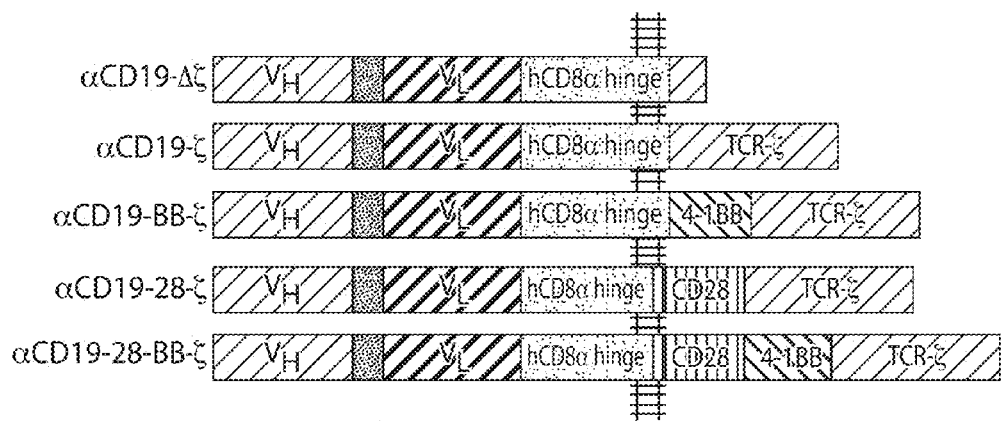
FIGS. 1A and 1B are schematics of representative CARs.
Figure 1B:
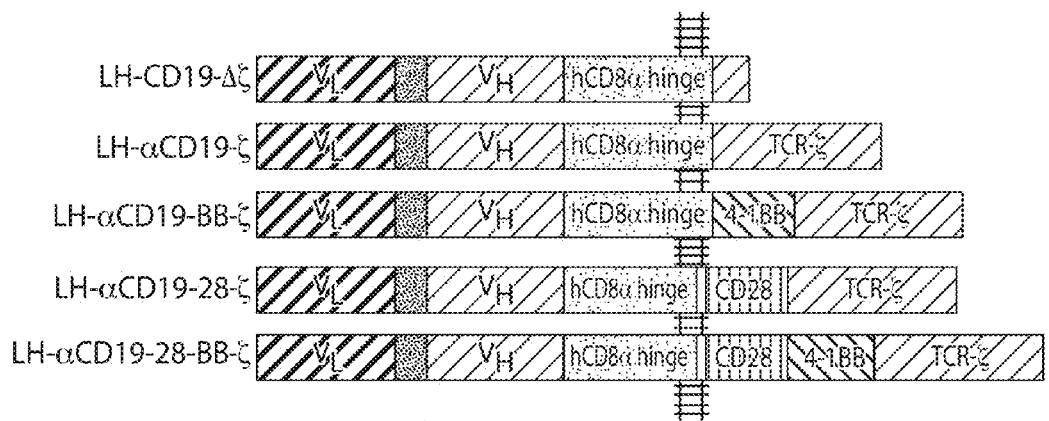

Unless defined otherwise, all technical and scientific terms used herein have the same meaning as commonly understood by one of ordinary skill in the art to which the invention pertains.

The term "a" and "an" refers to one or to more than one (i.e., to at least one) of the grammatical object of the article. By way of example, "an element" means one element or more than one element.

The term "about" when referring to a measurable value such as an amount, a temporal duration, and the like, is meant to encompass variations of ±20% or in some instances ±10%, or in some instances ±5%, or in some instances ±1%, or in some instances ±0.1% from the specified value, as such variations are appropriate to perform the disclosed methods.

The term "apheresis" as used herein refers to the art-recognized extracorporeal process by which the blood of a donor or patient is removed from the donor or patient and passed through an apparatus that separates out selected particular constituent(s) and returns the remainder to the circulation of the donor or patient, e.g., by retransfusion. Thus, "an apheresis sample" refers to a sample obtained using apheresis.

The term "bioequivalent" refers to an amount of an agent other than the reference compound (e.g., RAD001), required to produce an effect equivalent to the effect produced by the reference dose or reference amount of the reference compound (e.g., RAD001). In an embodiment the effect is the level of mTOR inhibition, e.g., as measured by P70 S6 kinase inhibition, e.g., as evaluated in an in vivo or in vitro assay, e.g., as measured by an assay described herein, e.g., the Boulay assay, or measurement of phosphorylated S6 levels by western blot. In an embodiment, the effect is alteration of the ratio of PD-1 positive/PD-1 negative T cells, as measured by cell sorting. In an embodiment a bioequivalent amount or dose of an mTOR inhibitor is the amount or dose that achieves the same level of P70 S6 kinase inhibition as does the reference dose or reference amount of a reference compound. In an embodiment, a bioequivalent amount or dose of an mTOR inhibitor is the amount or dose that achieves the same level of alteration in the ratio of PD-1 positive/PD-1 negative T cells as does the reference dose or reference amount of a reference compound.

The term "inhibition" or "inhibitor" includes a reduction in a certain parameter, e.g., an activity, of a given molecule, e.g., CD20, CD10, CD19, CD22, CD34, CD123, FLT-3, ROR1, CD79b, CD179b, or CD79a. For example, inhibition of an activity, e.g., an activity of CD20, CD10, CD19, CD22, CD34, CD123, FLT-3, ROR1, CD79b, CD179b, or CD79a, of at least 5%, 10%, 20%, 30%, 40%, or more is included by this term. Thus, inhibition need not be 100%. Activities for the inhibitors can be determined as described herein or by assays known in the art. A "B-cell inhibitor" is a molecule, e.g., a small molecule, antibody, CAR or cell comprising a CAR, which causes the reduction in a certain parameter, e.g., an activity, e.g., growth or proliferation, of a B-cell, or which causes a reduction in a certain parameter, e.g., an activity, of a molecule associated with a B cell. Non-limiting examples of molecules associated with a B cell include proteins expressed on the surface of B cells, e.g., CD20, CD10, CD19, CD22, CD34, CD123, FLT-3, ROR1, CD79b, CD179b, or CD79a.

The term "Chimeric Antigen Receptor" or alternatively a "CAR" refers to a set of polypeptides, typically two in the simplest embodiments, which when in an immune effector cell, provides the cell with specificity for a target cell, typically a cancer cell, and with intracellular signal generation. In some embodiments, a CAR comprises at least an extracellular antigen binding domain, a transmembrane domain and a cytoplasmic signaling domain (also referred to herein as "an intracellular signaling domain") comprising a functional signaling domain derived from a stimulatory molecule and/or costimulatory molecule as defined below. In some embodiments, the set of polypeptides are in the same polypeptide chain, e.g., comprise a chimeric fusion protein. In some embodiments, the set of polypeptides are not contiguous with each other, e.g., are in different polypeptide chains. In some embodiments, the set of polypeptides include a dimerization switch that, upon the presence of a dimerization molecule, can couple the polypeptides to one another, e.g., can couple an antigen binding domain to an intracellular signaling domain. In one aspect, the stimulatory molecule of the CAR is the zeta chain associated with the T cell receptor complex (e.g., CD3 zeta). In one aspect, the cytoplasmic signaling domain comprises a primary signaling domain (e.g., a primary signaling domain of CD3-zeta). In one aspect, the cytoplasmic signaling domain further comprises one or more functional signaling domains derived from at least one costimulatory molecule as defined below. In one aspect, the costimulatory molecule is chosen from the costimulatory molecules described herein, e.g., 4-1BB (i.e., CD137), CD27, and/or CD28. In one aspect, the CAR comprises a chimeric fusion protein comprising an extracellular antigen binding domain, a transmembrane domain and an intracellular signaling domain comprising a functional signaling domain derived from a stimulatory molecule. In one aspect, the CAR comprises a chimeric fusion protein comprising an extracellular antigen binding domain, a transmembrane domain and an intracellular signaling domain comprising a functional signaling domain derived from a costimulatory molecule and a functional signaling domain derived from a stimulatory molecule. In one aspect, the CAR comprises a chimeric fusion protein comprising an extracellular antigen binding domain, a transmembrane domain and an intracellular signaling domain comprising two functional signaling domains derived from one or more costimulatory molecule(s) and a functional signaling domain derived from a stimulatory molecule. In one aspect, the CAR comprises a chimeric fusion protein comprising an extracellular antigen binding domain, a transmembrane domain and an intracellular signaling domain comprising at least two functional signaling domains derived from one or more costimulatory molecule(s) and a functional signaling domain derived from a stimulatory molecule. In one aspect the CAR comprises an optional leader sequence at the amino-terminus (N-ter) of the CAR fusion protein. In one aspect, the CAR further comprises a leader sequence at the N-terminus of the extracellular antigen binding domain, wherein the leader sequence is optionally cleaved from the antigen binding domain (e.g., a scFv) during cellular processing and localization of the CAR to the cellular membrane.

The phrase "disease associated with expression of CD20" as used herein includes but is not limited to, a disease associated with expression of CD20 (e.g., wild-type or mutant CD20) or condition associated with cells which express, or at any time expressed, CD20 (e.g., wild-type or mutant CD20) including, e.g., a proliferative disease such as a cancer or malignancy or a precancerous condition such as a myelodysplasia, a myelodysplastic syndrome or a preleukemia; or a noncancer related indication associated with cells which express CD20 (e.g., wild-type or mutant CD20). For the avoidance of doubt, a disease associated with expression of CD20 may include a condition associated with cells which do not presently express CD20, e.g., because CD20 expression has been downregulated, e.g., due to treatment with a molecule targeting CD20, e.g., a CD20 CAR, but which at one time expressed CD20. In one aspect, a cancer associated with expression of CD20 is a hematological cancer. In one aspect, a hematological cancer includes but is not limited to AML, myelodysplastic syndrome, ALL, hairy cell leukemia, Prolymphocytic leukemia, Chronic myeloid leukemia, Hodgkin lymphoma, Blastic plasmacytoid dendritic cell neoplasm, and the like. Further disease associated with expression of CD20 expression include, but are not limited to, e.g., atypical and/or non-classical cancers, malignancies, precancerous conditions or proliferative diseases associated with expression of CD20. Non-cancer related indications associated with expression of CD20 may also be included. In some embodiments, the CD20-expressing cells express, or at any time expressed, CD20 mRNA. In an embodiment, the CD20-expressing cells produce a CD20 protein (e.g., wild-type or mutant), and the CD20 protein may be present at normal levels or reduced levels. In an embodiment, the CD20-expressing cells produced detectable levels of a CD20 protein at one point, and subsequently produced substantially no detectable CD20 protein.

The phrase "disease associated with expression of CD22" as used herein includes but is not limited to, a disease associated with expression of CD22 (e.g., wild-type or mutant CD22) or condition associated with cells which express, or at any time expressed, CD22 (e.g., wild-type or mutant CD22) including, e.g., a proliferative disease such as a cancer or malignancy or a precancerous condition such as a myelodysplasia, a myelodysplastic syndrome or a preleukemia; or a noncancer related indication associated with cells which express CD22 (e.g., wild-type or mutant CD22). For the avoidance of doubt, a disease associated with expression of CD22 may include a condition associated with cells which do not presently express CD22, e.g., because CD22 expression has been downregulated, e.g., due to treatment with a molecule targeting CD22, e.g., a CD22 CAR, but which at one time expressed CD22. In one aspect, a cancer associated with expression of CD22 is a hematological cancer. In one aspect, a hematological cancer includes but is not limited to AML, myelodysplastic syndrome, ALL, hairy cell leukemia, Prolymphocytic leukemia, Chronic myeloid leukemia, Hodgkin lymphoma, Blastic plasmacytoid dendritic cell neoplasm, and the like. Further disease associated with expression of CD22 expression include, but are not limited to, e.g., atypical and/or non-classical cancers, malignancies, precancerous conditions or proliferative diseases associated with expression of CD22. Non-cancer related indications associated with expression of CD22 may also be included. In some embodiments, the CD22-expressing cells express, or at any time expressed, CD22 mRNA. In an embodiment, the CD22-expressing cells produce a CD22 protein (e.g., wild-type or mutant), and the CD22 protein may be present at normal levels or reduced levels. In an embodiment, the CD22-expressing cells produced detectable levels of a CD22 protein at one point, and subsequently produced substantially no detectable CD22 protein.

As used herein, unless otherwise specified, the terms "prevent," "preventing" and "prevention" refer to an action that occurs before the subject begins to suffer from the condition, or relapse of the condition. Prevention need not result in a complete prevention of the condition; partial prevention or reduction of the condition or a symptom of the condition, or reduction of the risk of developing the condition, is encompassed by this term.

Administered "in combination", as used herein, means that two (or more) different treatments are delivered to the subject during the course of the subject's affliction with the disorder, e.g., the two or more treatments are delivered after the subject has been diagnosed with the disorder and before the disorder has been cured or eliminated or treatment has ceased for other reasons. In some embodiments, the delivery of one treatment is still occurring when the delivery of the second begins, so that there is overlap in terms of administration. This is sometimes referred to herein as "simultaneous" or "concurrent delivery". In other embodiments, the delivery of one treatment ends before the delivery of the other treatment begins. In some embodiments of either case, the treatment is more effective because of combined administration. For example, the second treatment is more effective, e.g., an equivalent effect is seen with less of the second treatment, or the second treatment reduces symptoms to a greater extent, than would be seen if the second treatment were administered in the absence of the first treatment, or the analogous situation is seen with the first treatment. In some embodiments, delivery is such that the reduction in a symptom, or other parameter related to the disorder is greater than what would be observed with one treatment delivered in the absence of the other. The effect of the two treatments can be partially additive, wholly additive, or greater than additive. The delivery can be such that an effect of the first treatment delivered is still detectable when the second is delivered. In one embodiment, the CAR-expressing cell is administered at a dose and/or dosing schedule described herein, and the B-cell inhibitor, or agent that enhances the activity of the CD19 CAR-expressing cell is administered at a dose and/or dosing schedule described herein.

"Derived from" as that term is used herein, indicates a relationship between a first and a second molecule. It generally refers to structural similarity between the first molecule and a second molecule and does not connote or include a process or source limitation on a first molecule that is derived from a second molecule. For example, in the case of an intracellular signaling domain that is derived from a CD3zeta molecule, the intracellular signaling domain retains sufficient CD3zeta structure such that is has the required function, namely, the ability to generate a signal under the appropriate conditions. It does not connote or include a limitation to a particular process of producing the intracellular signaling domain, e.g., it does not mean that, to provide the intracellular signaling domain, one must start with a CD3zeta sequence and delete unwanted sequence, or impose mutations, to arrive at the intracellular signaling domain.

The term "signaling domain" refers to the functional portion of a protein which acts by transmitting information within the cell to regulate cellular activity via defined signaling pathways by generating second messengers or functioning as effectors by responding to such messengers.

As used herein, the term "CD19" refers to the Cluster of Differentiation 19 protein, which is an antigenic determinant detectable on leukemia precursor cells. The human and murine amino acid and nucleic acid sequences can be found in a public database, such as GenBank, UniProt and Swiss-Prot. For example, the amino acid sequence of human CD19 can be found as UniProt/Swiss-Prot Accession No. P15391 and the nucleotide sequence encoding of the human CD19 can be found at Accession No. NM_001178098. As used herein, "CD19" includes proteins comprising mutations, e.g., point mutations, fragments, insertions, deletions and splice variants of full length wild-type CD19. CD19 is expressed on most B lineage cancers, including, e.g., acute lymphoblastic leukemia, chronic lymphocyte leukemia and non-Hodgkin lymphoma. Other cells with express CD19 are provided below in the definition of "disease associated with expression of CD19." It is also an early marker of B cell progenitors. See, e.g., Nicholson et al. Mol. Immun. 34 (16-17): 1157-1165 (1997). In one aspect the antigen-binding portion of the CART recognizes and binds an antigen within the extracellular domain of the CD19 protein. In one aspect, the CD19 protein is expressed on a cancer cell.

The term "antibody," as used herein, refers to a protein, or polypeptide sequence derived from an immunoglobulin molecule which specifically binds with an antigen. Antibodies can be polyclonal or monoclonal, multiple or single chain, or intact immunoglobulins, and may be derived from natural sources or from recombinant sources. Antibodies can be tetramers of immunoglobulin molecules.

The term "antibody fragment" refers to at least one portion of an antibody, that retains the ability to specifically interact with (e.g., by binding, steric hindrance, stabilizing/destabilizing, spatial distribution) an epitope of an antigen. Examples of antibody fragments include, but are not limited to, Fab, Fab', F(ab')$_2$, Fv fragments, scFv antibody fragments, disulfide-linked Fvs (sdFv), a Fd fragment consisting of the VH and CH1 domains, linear antibodies, single domain antibodies such as sdAb (either VL or VH), camelid VHH domains, multi-specific antibodies formed from antibody fragments such as a bivalent fragment comprising two Fab fragments linked by a disulfide bridge at the hinge region, and an isolated CDR or other epitope binding fragments of an antibody. An antigen binding fragment can also be incorporated into single domain antibodies, maxibodies, minibodies, nanobodies, intrabodies, diabodies, triabodies, tetrabodies, v-NAR and bis-scFv (see, e.g., Hollinger and Hudson, Nature Biotechnology 23:1126-1136, 2005). Antigen binding fragments can also be grafted into scaffolds based on polypeptides such as a fibronectin type III (Fn3)(see U.S. Pat. No. 6,703,199, which describes fibronectin polypeptide minibodies).

The term "scFv" refers to a fusion protein comprising at least one antibody fragment comprising a variable region of a light chain and at least one antibody fragment comprising a variable region of a heavy chain, wherein the light and heavy chain variable regions are contiguously linked, e.g., via a synthetic linker, e.g., a short flexible polypeptide linker, and capable of being expressed as a single chain polypeptide, and wherein the scFv retains the specificity of the intact antibody from which it is derived. Unless specified, as used herein an scFv may have the VL and VH variable regions in either order, e.g., with respect to the N-terminal and C-terminal ends of the polypeptide, the scFv may comprise VL-linker-VH or may comprise VH-linker-VL.

The term "complementarity determining region" or "CDR," as used herein, refers to the sequences of amino acids within antibody variable regions which confer antigen specificity and binding affinity. For example, in general, there are three CDRs in each heavy chain variable region (e.g., HCDR1, HCDR2, and HCDR3) and three CDRs in each light chain variable region (LCDR1, LCDR2, and LCDR3). The precise amino acid sequence boundaries of a given CDR can be determined using any of a number of well-known schemes, including those described by Kabat et al. (1991), "Sequences of Proteins of Immunological Interest," 5th Ed. Public Health Service, National Institutes of Health, Bethesda, Md. ("Kabat" numbering scheme), Al-Lazikani et al., (1997) JMB 273,927-948 ("Chothia" numbering scheme), or a combination thereof. Under the Kabat numbering scheme, in some embodiments, the CDR amino acid residues in the heavy chain variable domain (VH) are numbered 31-35 (HCDR1), 50-65 (HCDR2), and 95-102 (HCDR3); and the CDR amino acid residues in the light chain variable domain (VL) are numbered 24-34 (LCDR1), 50-56 (LCDR2), and 89-97 (LCDR3). Under the Chothia numbering scheme, in some embodiments, the CDR amino acids in the VH are numbered 26-32 (HCDR1), 52-56 (HCDR2), and 95-102 (HCDR3); and the CDR amino acid residues in the VL are numbered 26-32 (LCDR1), 50-52 (LCDR2), and 91-96 (LCDR3). In a combined Kabat and Chothia numbering scheme, in some embodiments, the CDRs correspond to the amino acid residues that are part of a Kabat CDR, a Chothia CDR, or both. For instance, in some embodiments, the CDRs correspond to amino acid residues 26-35 (HCDR1), 50-65 (HCDR2), and 95-102 (HCDR3) in a VH, e.g., a mammalian VH, e.g., a human VH; and amino acid residues 24-34 (LCDR1), 50-56 (LCDR2), and 89-97 (LCDR3) in a VL, e.g., a mammalian VL, e.g., a human VL.

As used herein, the term "binding domain" or "antibody molecule" refers to a protein, e.g., an immunoglobulin chain or fragment thereof, comprising at least one immunoglobulin variable domain sequence. The term "binding domain" or "antibody molecule" encompasses antibodies and antibody fragments. In an embodiment, an antibody molecule is a multispecific antibody molecule, e.g., it comprises a plurality of immunoglobulin variable domain sequences, wherein a first immunoglobulin variable domain sequence of the plurality has binding specificity for a first epitope and a second immunoglobulin variable domain sequence of the plurality has binding specificity for a second epitope. In an embodiment, a multispecific antibody molecule is a bispecific antibody molecule. A bispecific antibody has specificity for no more than two antigens. A bispecific antibody molecule is characterized by a first immunoglobulin variable domain sequence which has binding specificity for a first epitope and a second immunoglobulin variable domain sequence that has binding specificity for a second epitope.

The portion of the CAR of the invention comprising an antibody or antibody fragment thereof may exist in a variety of forms where the antigen binding domain is expressed as part of a contiguous polypeptide chain including, for example, a single domain antibody fragment (sdAb), a single chain antibody (scFv), a humanized antibody, or bispecific antibody (Harlow et al., 1999, In: Using Antibodies: A Laboratory Manual, Cold Spring Harbor Laboratory Press, NY; Harlow et al., 1989, In: Antibodies: A Laboratory Manual, Cold Spring Harbor, N.Y.; Houston et al., 1988, Proc. Natl. Acad. Sci. USA 85:5879-5883; Bird et al., 1988, Science 242:423-426). In one aspect, the antigen binding domain of a CAR composition of the invention comprises an antibody fragment. In a further aspect, the CAR comprises an antibody fragment that comprises a scFv.

The term "antibody heavy chain," refers to the larger of the two types of polypeptide chains present in antibody molecules in their naturally occurring conformations, and which normally determines the class to which the antibody belongs.

The term "antibody light chain," refers to the smaller of the two types of polypeptide chains present in antibody molecules in their naturally occurring conformations. Kappa (κ) and lambda (λ) light chains refer to the two major antibody light chain isotypes.

The term "recombinant antibody" refers to an antibody which is generated using recombinant DNA technology, such as, for example, an antibody expressed by a bacteriophage or yeast expression system. The term should also be construed to mean an antibody which has been generated by the synthesis of a DNA molecule encoding the antibody and which DNA molecule expresses an antibody protein, or an amino acid sequence specifying the antibody, wherein the DNA or amino acid sequence has been obtained using recombinant DNA or amino acid sequence technology which is available and well known in the art.

The term "antigen" or "Ag" refers to a molecule that provokes an immune response. This immune response may involve either antibody production, or the activation of specific immunologically-competent cells, or both. The skilled artisan will understand that any macromolecule, including virtually all proteins or peptides, can serve as an antigen. Furthermore, antigens can be derived from recombinant or genomic DNA. A skilled artisan will understand that any DNA, which comprises a nucleotide sequences or a partial nucleotide sequence encoding a protein that elicits an immune response therefore encodes an "antigen" as that term is used herein. Furthermore, one skilled in the art will understand that an antigen need not be encoded solely by a full length nucleotide sequence of a gene. It is readily apparent that the present invention includes, but is not limited to, the use of partial nucleotide sequences of more than one gene and that these nucleotide sequences are arranged in various combinations to encode polypeptides that elicit the desired immune response. Moreover, a skilled artisan will understand that an antigen need not be encoded by a "gene" at all. It is readily apparent that an antigen can be generated synthesized or can be derived from a biological sample, or might be macromolecule besides a polypeptide. Such a biological sample can include, but is not limited to a tissue sample, a tumor sample, a cell or a fluid with other biological components.

The terms "compete" or "cross-compete" are used interchangeably herein to refer to the ability of an antibody molecule to interfere with binding of an antibody molecule, e.g., an anti-CD20 or CD22 antibody molecule provided herein, to a target, e.g., human CD20 or CD22. The interference with binding can be direct or indirect (e.g., through an allosteric modulation of the antibody molecule or the target). The extent to which an antibody molecule is able to interfere with the binding of another antibody molecule to the target, and therefore whether it can be said to compete, can be determined using a competition binding assay, e.g., as described herein. In some embodiments, a competition binding assay is a quantitative competition assay. In some embodiments, a first antibody molecule is said to compete for binding to the target with a second antibody molecule when the binding of the first antibody molecule to the target is reduced by 10% or more, e.g., 20% or more, 30% or more, 40% or more, 50% or more, 55% or more, 60% or more, 65% or more, 70% or more, 75% or more, 80% or more, 85% or more, 90% or more, 95% or more, 98% or more, 99% or more in a competition binding assay (e.g., a competition assay described herein).

As used herein, the term "epitope" refers to the moieties of an antigen (e.g., human CD20 or CD22) that specifically interact with an antibody molecule. Such moieties, referred to herein as epitopic determinants, typically comprise, or are part of, elements such as amino acid side chains or sugar side chains. An epitopic determinate can be defined, e.g., by methods known in the art or disclosed herein, e.g., by crystallography or by hydrogen-deuterium exchange. At least one or some of the moieties on the antibody molecule, that specifically interact with an epitopic determinant, are typically located in a CDR(s). Typically an epitope has a specific three dimensional structural characteristics. Typically an epitope has specific charge characteristics. Some epitopes are linear epitopes while others are conformational epitopes.

The term "anti-cancer effect" refers to a biological effect which can be manifested by various means, including but not limited to, e.g., a decrease in tumor volume, a decrease in the number of cancer cells, a decrease in the number of metastases, an increase in life expectancy, decrease in cancer cell proliferation, decrease in cancer cell survival, or amelioration of various physiological symptoms associated with the cancerous condition. An "anti-cancer effect" can also be manifested by the ability of the peptides, polynucleotides, cells and antibodies described herein in prevention of the occurrence of cancer in the first place. The term "anti-tumor effect" refers to a biological effect which can be manifested by various means, including but not limited to, e.g., a decrease in tumor volume, a decrease in the number of tumor cells, a decrease in tumor cell proliferation, or a decrease in tumor cell survival.

The term "autologous" refers to any material derived from the same individual to whom it is later to be re-introduced into the individual.

The term "allogeneic" refers to any material derived from a different animal of the same species as the individual to whom the material is introduced. Two or more individuals are said to be allogeneic to one another when the genes at one or more loci are not identical. In some aspects, allogeneic material from individuals of the same species may be sufficiently unlike genetically to interact antigenically.

The term "xenogeneic" refers to a graft derived from an animal of a different species.

The term "cancer" refers to a disease characterized by the uncontrolled growth of aberrant cells. Cancer cells can spread locally or through the bloodstream and lymphatic system to other parts of the body. Examples of various cancers are described herein and include but are not limited to, breast cancer, prostate cancer, ovarian cancer, cervical cancer, skin cancer, pancreatic cancer, colorectal cancer, renal cancer, liver cancer, brain cancer, lymphoma, leukemia, lung cancer and the like. The terms "tumor" and "cancer" are used interchangeably herein, e.g., both terms encompass solid and liquid, e.g., diffuse or circulating, tumors. As used herein, the term "cancer" or "tumor" includes premalignant, as well as malignant cancers and tumors.

The terms "cancer associated antigen" or "tumor antigen" or "proliferative disorder antigen" or "antigen associated with a proliferative disorder" interchangeably refers to a molecule (typically protein, carbohydrate or lipid) that is preferentially expressed on the surface of a cancer cell, either entirely or as a fragment (e.g., MHC/peptide), in comparison to a normal cell, and which is useful for the preferential targeting of a pharmacological agent to the cancer cell. In some embodiments, a tumor antigen is a marker expressed by both normal cells and cancer cells, e.g., a lineage marker, e.g., CD19 on B cells. In certain aspects, the tumor antigens of the present invention are derived from, cancers including but not limited to primary or metastatic melanoma, thymoma, lymphoma, sarcoma, lung cancer, liver cancer, non-Hodgkin lymphoma, Hodgkin lymphoma, leukemias, uterine cancer, cervical cancer, bladder cancer, kidney cancer and adenocarcinomas such as breast cancer, prostate cancer, ovarian cancer, pancreatic cancer, and the like. In some embodiments, the tumor antigen is an antigen that is common to a specific proliferative disorder. In some embodiments, a cancer-associated antigen is a cell surface molecule that is overexpressed in a cancer cell in comparison to a normal cell, for instance, 1-fold over expression, 2-fold overexpression, 3-fold overexpression or more in comparison to a normal cell. In some embodiments, a cancer-associated antigen is a cell surface molecule that is inappropriately synthesized in the cancer cell, for instance, a molecule that contains deletions, additions or mutations in comparison to the molecule expressed on a normal cell. In some embodiments, a cancer-associated antigen will be expressed exclusively on the cell surface of a cancer cell, entirely or as a fragment (e.g., MHC/peptide), and not synthesized or expressed on the surface of a normal cell. In some embodiments, the CARs of the present invention includes CARs comprising an antigen binding domain (e.g., antibody or antibody fragment) that binds to a MHC presented peptide. Normally, peptides derived from endogenous proteins fill the pockets of Major histocompatibility complex (MHC) class I molecules, and are recognized by T cell receptors (TCRs) on CD8+ T lymphocytes. The MHC class I complexes are constitutively expressed by all nucleated cells. In cancer, virus-specific and/or tumor-specific peptide/MHC complexes represent a unique class of cell surface targets for immunotherapy. TCR-like antibodies targeting peptides derived from viral or tumor antigens in the context of human leukocyte antigen (HLA)-A1 or HLA-A2 have been described (see, e.g., Sastry et al., J Virol. 2011 85(5):1935-1942; Sergeeva et al., Bood, 2011 117(16):4262-4272; Verma et al., J Immunol 2010 184(4):2156-2165; Willemsen et al., Gene Ther 2001 8(21):1601-1608; Dao et al., Sci Transl Med 2013 5(176):176ra33; Tassev et al., Cancer Gene Ther 2012 19(2):84-100). For example, TCR-like antibody can be identified from screening a library, such as a human scFv phage displayed library.

The phrase "disease associated with expression of CD19" includes, but is not limited to, a disease associated with expression of CD19 (e.g., wild-type or mutant CD19) or condition associated with cells which express, or at any time expressed, CD19 (e.g., wild-type or mutant CD19) including, e.g., proliferative diseases such as a cancer or malignancy or a precancerous condition such as a myelodysplasia, a myelodysplastic syndrome or a preleukemia; or a noncancer related indication associated with cells which express CD19. For the avoidance of doubt, a disease associated with expression of CD19 may include a condition associated with cells which do not presently express CD19, e.g., because CD19 expression has been downregulated, e.g., due to treatment with a molecule targeting CD19, e.g., a CD19 CAR, but which at one time expressed CD19. In one aspect, a cancer associated with expression of CD19 is a hematological cancer. In one aspect, the hematological cancer is a leukemia or a lymphoma. In one aspect, a cancer associated with expression of CD19 includes cancers and malignancies including, but not limited to, e.g., one or more acute leukemias including but not limited to, e.g., B-cell acute Lymphoid Leukemia (BALL), T-cell acute Lymphoid Leukemia (TALL), acute lymphoid leukemia (ALL); one or more chronic leukemias including but not limited to, e.g., chronic myelogenous leukemia (CML), Chronic Lymphoid Leukemia (CLL). Additional cancers or hematologic conditions associated with expression of CD19 comprise, but are not limited to, e.g., B cell prolymphocytic leukemia, blastic plasmacytoid dendritic cell neoplasm, Burkitt's lymphoma, diffuse large B cell lymphoma, Follicular lymphoma, Hairy cell leukemia, small cell- or a large cell-follicular lymphoma, malignant lymphoproliferative conditions, MALT lymphoma, mantle cell lymphoma (MCL), Marginal zone lymphoma, multiple myeloma, myelodysplasia and myelodysplastic syndrome, non-Hodgkin lymphoma, Hodgkin lymphoma, plasmablastic lymphoma, plasmacytoid dendritic cell neoplasm, Waldenstrom macroglobulinemia, and "preleukemia" which are a diverse collection of hematological conditions united by ineffective production (or dysplasia) of myeloid blood cells, and the like. Further diseases associated with expression of CD19 expression include, but not limited to, e.g., atypical and/or non-classical cancers, malignancies, precancerous conditions or proliferative diseases associated with expression of CD19. Non-cancer related indications associated with expression of CD19 include, but are not limited to, e.g., autoimmune disease, (e.g., lupus), inflammatory disorders (allergy and asthma) and transplantation. In some embodiments, the CD19-expressing cells express, or at any time expressed, CD19 mRNA. In an embodiment, the CD19-expressing cells produce a CD19 protein (e.g., wild-type or mutant), and the CD19 protein may be present at normal levels or reduced levels. In an embodiment, the CD19-expressing cells produced detectable levels of a CD19 protein at one point, and subsequently produced substantially no detectable CD19 protein.

The term "conservative sequence modifications" refers to amino acid modifications that do not significantly affect or alter the binding characteristics of the antibody or antibody fragment containing the amino acid sequence. Such conservative modifications include amino acid substitutions, additions and deletions. Modifications can be introduced into an antibody or antibody fragment of the invention by standard techniques known in the art, such as site-directed mutagenesis and PCR-mediated mutagenesis. Conservative amino acid substitutions are ones in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine, tryptophan), nonpolar side chains (e.g., alanine, valine, leucine, isoleucine, proline, phenylalanine, methionine), beta-branched side chains (e.g., threonine, valine, isoleucine) and aromatic side chains (e.g., tyrosine, phenylalanine, tryptophan, histidine). Thus, one or more amino acid residues within a CAR of the invention can be replaced with other amino acid residues from the same side chain family and the altered CAR can be tested using the functional assays described herein.

The term "stimulation," refers to a primary response induced by binding of a stimulatory molecule (e.g., a TCR/CD3 complex or CAR) with its cognate ligand (or tumor antigen in the case of a CAR) thereby mediating a signal transduction event, such as, but not limited to, signal transduction via the TCR/CD3 complex or signal transduction via the appropriate NK receptor or signaling domains of the CAR. Stimulation can mediate altered expression of certain molecules.

The term "stimulatory molecule," refers to a molecule expressed by an immune cell, e.g., T cell, NK cell, or B cell) that provides the cytoplasmic signaling sequence(s) that regulate activation of the immune cell in a stimulatory way for at least some aspect of the immune cell signaling pathway. In one aspect, the signal is a primary signal that is initiated by, for instance, binding of a TCR/CD3 complex with an MHC molecule loaded with peptide, and which leads to mediation of a T cell response, including, but not limited to, proliferation, activation, differentiation, and the like. A primary cytoplasmic signaling sequence (also referred to as a "primary signaling domain") that acts in a stimulatory manner may contain a signaling motif which is known as immunoreceptor tyrosine-based activation motif or ITAM. Examples of an ITAM containing cytoplasmic signaling sequence that is of particular use in the invention includes, but is not limited to, those derived from CD3 zeta, common FcR gamma (FCER1G), Fc gamma RIIa, FcR beta (Fc Epsilon R1b), CD3 gamma, CD3 delta, CD3 epsilon, CD79a, CD79b, DAP10, and DAP12. In a specific CAR of the invention, the intracellular signaling domain in any one or more CARS of the invention comprises an intracellular signaling sequence, e.g., a primary signaling sequence of CD3-zeta. In a specific CAR of the invention, the primary signaling sequence of CD3-zeta is the sequence provided as SEQ ID NO:17, or the equivalent residues from a non-human species, e.g., mouse, rodent, monkey, ape and the like. In a specific CAR of the invention, the primary signaling sequence of CD3-zeta is the sequence as provided in SEQ ID NO:43, or the equivalent residues from a non-human species, e.g., mouse, rodent, monkey, ape and the like.

The term "antigen presenting cell" or "APC" refers to an immune system cell such as an accessory cell (e.g., a B-cell, a dendritic cell, and the like) that displays a foreign antigen complexed with major histocompatibility complexes (MHC's) on its surface. T-cells may recognize these complexes using their T-cell receptors (TCRs). APCs process antigens and present them to T-cells.

"Immune effector cell," as that term is used herein, refers to a cell that is involved in an immune response, e.g., in the promotion of an immune effector response. Examples of immune effector cells include T cells, e.g., alpha/beta T cells and gamma/delta T cells, B cells, natural killer (NK) cells, natural killer T (NK-T) cells, mast cells, and myeloid-derived phagocytes.

"Immune effector function or immune effector response," as that term is used herein, refers to function or response, e.g., of an immune effector cell, that enhances or promotes an immune attack of a target cell. E.g., an immune effector function or response refers a property of a T or NK cell that promotes killing or the inhibition of growth or proliferation, of a target cell. In the case of a T cell, primary stimulation and co-stimulation are examples of immune effector function or response.

The term "effector function" refers to a specialized function of a cell. Effector function of a T cell, for example, may be cytolytic activity or helper activity including the secretion of cytokines.

An "intracellular signaling domain," as the term is used herein, refers to an intracellular portion of a molecule. The intracellular signaling domain can generate a signal that promotes an immune effector function of the CAR containing cell, e.g., a CART cell. Examples of immune effector function, e.g., in a CART cell, include cytolytic activity and helper activity, including the secretion of cytokines. In embodiments, the intracellular signal domain is the portion of the protein which transduces the effector function signal and directs the cell to perform a specialized function. While the entire intracellular signaling domain can be employed, in many cases it is not necessary to use the entire chain. To the extent that a truncated portion of the intracellular signaling domain is used, such truncated portion may be used in place of the intact chain as long as it transduces the effector function signal. The term intracellular signaling domain is thus meant to include any truncated portion of the intracellular signaling domain sufficient to transduce the effector function signal.

In an embodiment, the intracellular signaling domain can comprise a primary intracellular signaling domain. Exemplary primary intracellular signaling domains include those derived from the molecules responsible for primary stimulation, or antigen dependent simulation. In an embodiment, the intracellular signaling domain can comprise a costimulatory intracellular domain. Exemplary costimulatory intracellular signaling domains include those derived from molecules responsible for costimulatory signals, or antigen independent stimulation. For example, in the case of a CART, a primary intracellular signaling domain can comprise a cytoplasmic sequence of a T cell receptor, and a costimulatory intracellular signaling domain can comprise cytoplasmic sequence from co-receptor or costimulatory molecule.

A primary intracellular signaling domain can comprise a signaling motif which is known as an immunoreceptor tyrosine-based activation motif or ITAM. Examples of ITAM containing primary cytoplasmic signaling sequences include, but are not limited to, those derived from CD3 zeta, FcR gamma, common FcR gamma (FCER1G), Fc gamma RIIa, FcR beta (Fc Epsilon R1b), CD3 gamma, CD3 delta, CD3 epsilon, CD22, CD79a, CD79b, CD278 ("ICOS"), FcεRI, CD66d, CD32, DAP10 and DAP12.

The term "zeta" or alternatively "zeta chain", "CD3-zeta" or "TCR-zeta" is defined as the protein provided as GenBank Acc. No. BAG36664.1, or the equivalent residues from a non-human species, e.g., mouse, rodent, monkey, ape and the like, and a "zeta stimulatory domain" or alternatively a "CD3-zeta stimulatory domain" or a "TCR-zeta stimulatory domain" is defined as the amino acid residues from the cytoplasmic domain of the zeta chain, or functional derivatives thereof, that are sufficient to functionally transmit an initial signal necessary for T cell activation. In one aspect the cytoplasmic domain of zeta comprises residues 52 through 164 of GenBank Acc. No. BAG36664.1 or the equivalent residues from a non-human species, e.g., mouse, rodent, monkey, ape and the like, that are functional orthologs thereof. In one aspect, the "zeta stimulatory domain" or a "CD3-zeta stimulatory domain" is the sequence provided as SEQ ID NO:17. In one aspect, the "zeta stimulatory domain" or a "CD3-zeta stimulatory domain" is the sequence provided as SEQ ID NO:43.

The term "costimulatory molecule" refers to the cognate binding partner on a T cell that specifically binds with a costimulatory ligand, thereby mediating a costimulatory response by the T cell, such as, but not limited to, proliferation. Costimulatory molecules are cell surface molecules other than antigen receptors or their ligands that contribute to an efficient immune response. Costimulatory molecules include, but are not limited to an MHC class I molecule, TNF receptor proteins, Immunoglobulin-like proteins, cytokine receptors, integrins, signalling lymphocytic activation molecules (SLAM proteins), activating NK cell receptors, BTLA, a Toll ligand receptor, OX40, CD2, CD7, CD27, CD28, CD30, CD40, CDS, ICAM-1, LFA-1 (CD11a/CD18), 4-1BB (CD137), B7-H3, CDS, ICAM-1, ICOS (CD278), GITR, BAFFR, LIGHT, HVEM (LIGHTR), KIRDS2, SLAMF7, NKp80 (KLRF1), NKp44, NKp30, NKp46, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, CD19a, and a ligand that specifically binds with CD83.

A costimulatory intracellular signaling domain refers to the intracellular portion of a costimulatory molecule. The intracellular signaling domain can comprise the entire intracellular portion, or the entire native intracellular signaling domain, of the molecule from which it is derived, or a functional fragment or derivative thereof.

The term "4-1BB" refers to a member of the TNFR superfamily with an amino acid sequence provided as GenBank Acc. No. AAA62478.2, or the equivalent residues from a non-human species, e.g., mouse, rodent, monkey, ape and the like; and a "4-1BB costimulatory domain" is defined as amino acid residues 214-255 of GenBank Acc. No. AAA62478.2, or the equivalent residues from a non-human species, e.g., mouse, rodent, monkey, ape and the like. In one aspect, the "4-1BB costimulatory domain" is the sequence provided as SEQ ID NO:16 or the equivalent residues from a non-human species, e.g., mouse, rodent, monkey, ape and the like.

The term "encoding" refers to the inherent property of specific sequences of nucleotides in a polynucleotide, such as a gene, a cDNA, or an mRNA, to serve as templates for synthesis of other polymers and macromolecules in biological processes having either a defined sequence of nucleotides (e.g., rRNA, tRNA and mRNA) or a defined sequence of amino acids and the biological properties resulting therefrom. Thus, a gene, cDNA, or RNA, encodes a protein if transcription and translation of mRNA corresponding to that gene produces the protein in a cell or other biological system. Both the coding strand, the nucleotide sequence of which is identical to the mRNA sequence and is usually provided in sequence listings, and the non-coding strand, used as the template for transcription of a gene or cDNA, can be referred to as encoding the protein or other product of that gene or cDNA.

Unless otherwise specified, a "nucleotide sequence encoding an amino acid sequence" includes all nucleotide sequences that are degenerate versions of each other and that encode the same amino acid sequence. The phrase nucleotide sequence that encodes a protein or a RNA may also include introns to the extent that the nucleotide sequence encoding the protein may in some version contain an intron(s).

The term "effective amount" or "therapeutically effective amount" are used interchangeably herein, and refer to an amount of a compound, formulation, material, or composition, as described herein effective to achieve a particular biological result.

The term "endogenous" refers to any material from or produced inside an organism, cell, tissue or system.

The term "exogenous" refers to any material introduced from or produced outside an organism, cell, tissue or system.

The term "expression" refers to the transcription and/or translation of a particular nucleotide sequence driven by a promoter.

The term "transfer vector" refers to a composition of matter which comprises an isolated nucleic acid and which can be used to deliver the isolated nucleic acid to the interior of a cell. Numerous vectors are known in the art including, but not limited to, linear polynucleotides, polynucleotides associated with ionic or amphiphilic compounds, plasmids, and viruses. Thus, the term "transfer vector" includes an autonomously replicating plasmid or a virus. The term should also be construed to further include non-plasmid and non-viral compounds which facilitate transfer of nucleic acid into cells, such as, for example, a polylysine compound, liposome, and the like. Examples of viral transfer vectors include, but are not limited to, adenoviral vectors, adeno-associated virus vectors, retroviral vectors, lentiviral vectors, and the like.

The term "expression vector" refers to a vector comprising a recombinant polynucleotide comprising expression control sequences operatively linked to a nucleotide sequence to be expressed. An expression vector comprises sufficient cis-acting elements for expression; other elements for expression can be supplied by the host cell or in an in vitro expression system. Expression vectors include all those known in the art, including cosmids, plasmids (e.g., naked or contained in liposomes) and viruses (e.g., lentiviruses, retroviruses, adenoviruses, and adeno-associated viruses) that incorporate the recombinant polynucleotide.

The term "lentivirus" refers to a genus of the Retroviridae family. Lentiviruses are unique among the retroviruses in being able to infect non-dividing cells; they can deliver a significant amount of genetic information into the DNA of the host cell, so they are one of the most efficient methods of a gene delivery vector. HIV, SIV, and FIV are all examples of lentiviruses.

The term "lentiviral vector" refers to a vector derived from at least a portion of a lentivirus genome, including especially a self-inactivating lentiviral vector as provided in Milone et al., Mol. Ther. 17(8): 1453-1464 (2009). Other examples of lentivirus vectors that may be used in the clinic, include but are not limited to, e.g., the LENTIVECTOR® gene delivery technology from Oxford BioMedica, the LENTIMAX™ vector system from Lentigen and the like. Nonclinical types of lentiviral vectors are also available and would be known to one skilled in the art.

The term "homologous" or "identity" refers to the subunit sequence identity between two polymeric molecules, e.g., between two nucleic acid molecules, such as, two DNA molecules or two RNA molecules, or between two polypeptide molecules. When a subunit position in both of the two molecules is occupied by the same monomeric subunit; e.g., if a position in each of two DNA molecules is occupied by adenine, then they are homologous or identical at that position. The homology between two sequences is a direct function of the number of matching or homologous positions; e.g., if half (e.g., five positions in a polymer ten subunits in length) of the positions in two sequences are homologous, the two sequences are 50% homologous; if 90% of the positions (e.g., 9 of 10), are matched or homologous, the two sequences are 90% homologous.

"Humanized" forms of non-human (e.g., murine) antibodies are chimeric immunoglobulins, immunoglobulin chains or fragments thereof (such as Fv, Fab, Fab', F(ab')2 or other antigen-binding subsequences of antibodies) which contain minimal sequence derived from non-human immunoglobulin. For the most part, humanized antibodies and antibody fragments thereof are human immunoglobulins (recipient antibody or antibody fragment) in which residues from a complementary-determining region (CDR) of the recipient are replaced by residues from a CDR of a non-human species (donor antibody) such as mouse, rat or rabbit having the desired specificity, affinity, and capacity. In some instances, Fv framework region (FR) residues of the human immunoglobulin are replaced by corresponding non-human residues. Furthermore, a humanized antibody/antibody fragment can comprise residues which are found neither in the recipient antibody nor in the imported CDR or framework sequences. These modifications can further refine and optimize antibody or antibody fragment performance. In general, the humanized antibody or antibody fragment thereof will comprise substantially all of at least one, and typically two, variable domains, in which all or substantially all of the CDR regions correspond to those of a non-human immunoglobulin and all or a significant portion of the FR regions are those of a human immunoglobulin sequence. The humanized antibody or antibody fragment can also comprise at least a portion of an immunoglobulin constant region (Fc), typically that of a human immunoglobulin. For further details, see Jones et al., Nature, 321: 522-525, 1986; Reichmann et al., Nature, 332: 323-329, 1988; Presta, Curr. Op. Struct. Biol., 2: 593-596, 1992.

"Fully human" refers to an immunoglobulin, such as an antibody or antibody fragment, where the whole molecule is of human origin or consists of an amino acid sequence identical to a human form of the antibody or immunoglobulin.

The term "isolated" means altered or removed from the natural state. For example, a nucleic acid or a peptide naturally present in a living animal is not "isolated," but the same nucleic acid or peptide partially or completely separated from the coexisting materials of its natural state is "isolated." An isolated nucleic acid or protein can exist in substantially purified form, or can exist in a non-native environment such as, for example, a host cell.

In the context of the present invention, the following abbreviations for the commonly occurring nucleic acid bases are used. "A" refers to adenosine, "C" refers to cytosine, "G" refers to guanosine, "T" refers to thymidine, and "U" refers to uridine.

The term "operably linked" or "transcriptional control" refers to functional linkage between a regulatory sequence and a heterologous nucleic acid sequence resulting in expression of the latter. For example, a first nucleic acid sequence is operably linked with a second nucleic acid sequence when the first nucleic acid sequence is placed in a functional relationship with the second nucleic acid sequence. For instance, a promoter is operably linked to a coding sequence if the promoter affects the transcription or expression of the coding sequence. Operably linked DNA sequences can be contiguous with each other and, e.g., where necessary to join two protein coding regions, are in the same reading frame.

The term "parenteral" administration of an immunogenic composition includes, e.g., subcutaneous (s.c.), intravenous (i.v.), intramuscular (i.m.), or intrasternal injection, intratumoral, or infusion techniques.

The term "nucleic acid" or "polynucleotide" refers to deoxyribonucleic acids (DNA) or ribonucleic acids (RNA) and polymers thereof in either single- or double-stranded form. The term "nucleic acid" includes a gene, cDNA, or an mRNA. In one embodiment, the nucleic acid molecule is synthetic (e.g., chemically synthesized) or recombinant. Unless specifically limited, the term encompasses nucleic acids containing analogues or derivatives of natural nucleotides that have similar binding properties as the reference nucleic acid and are metabolized in a manner similar to naturally occurring nucleotides. Unless otherwise indicated, a particular nucleic acid sequence also implicitly encompasses conservatively modified variants thereof (e.g., degenerate codon substitutions), alleles, orthologs, SNPs, and complementary sequences as well as the sequence explicitly indicated. Specifically, degenerate codon substitutions may be achieved by generating sequences in which the third position of one or more selected (or all) codons is substituted with mixed-base and/or deoxyinosine residues (Batzer et al., Nucleic Acid Res. 19:5081 (1991); Ohtsuka et al., J. Biol. Chem. 260:2605-2608 (1985); and Rossolini et al., Mol. Cell. Probes 8:91-98 (1994)).

The terms "peptide," "polypeptide," and "protein" are used interchangeably, and refer to a compound comprised of amino acid residues covalently linked by peptide bonds. A protein or peptide must contain at least two amino acids, and no limitation is placed on the maximum number of amino acids that can comprise a protein's or peptide's sequence. Polypeptides include any peptide or protein comprising two or more amino acids joined to each other by peptide bonds. As used herein, the term refers to both short chains, which also commonly are referred to in the art as peptides, oligopeptides and oligomers, for example, and to longer chains, which generally are referred to in the art as proteins, of which there are many types. "Polypeptides" include, for example, biologically active fragments, substantially homologous polypeptides, oligopeptides, homodimers, heterodimers, variants of polypeptides, modified polypeptides, derivatives, analogs, fusion proteins, among others. A polypeptide includes a natural peptide, a recombinant peptide, or a combination thereof.

The term "promoter" refers to a DNA sequence recognized by the synthetic machinery of the cell, or introduced synthetic machinery, required to initiate the specific transcription of a polynucleotide sequence.

The term "promoter/regulatory sequence" refers to a nucleic acid sequence which is required for expression of a gene product operably linked to the promoter/regulatory sequence. In some instances, this sequence may be the core promoter sequence and in other instances, this sequence may also include an enhancer sequence and other regulatory elements which are required for expression of the gene product. The promoter/regulatory sequence may, for example, be one which expresses the gene product in a tissue specific manner.

The term "constitutive" promoter refers to a nucleotide sequence which, when operably linked with a polynucleotide which encodes or specifies a gene product, causes the gene product to be produced in a cell under most or all physiological conditions of the cell.

The term "inducible" promoter refers to a nucleotide sequence which, when operably linked with a polynucleotide which encodes or specifies a gene product, causes the gene product to be produced in a cell substantially only when an inducer which corresponds to the promoter is present in the cell.

The term "tissue-specific" promoter refers to a nucleotide sequence which, when operably linked with a polynucleotide encodes or specified by a gene, causes the gene product to be produced in a cell substantially only if the cell is a cell of the tissue type corresponding to the promoter.

The term "flexible polypeptide linker" or "linker" as used in the context of a scFv refers to a peptide linker that consists of amino acids such as glycine and/or serine residues used alone or in combination, to link variable heavy and variable light chain regions together. In one embodiment, the flexible polypeptide linker is a Gly/Ser linker and comprises the amino acid sequence (Gly-Gly-Gly-Ser)$_n$, where n is a positive integer equal to or greater than 1. For example, n=1, n=2, n=3. n=4, n=5, n=6, n=7, n=8, n=9 and n=10 (SEQ ID NO:105). In one embodiment, the flexible polypeptide linkers include, but are not limited to, (Gly$_4$ Ser)$_4$ (SEQ ID NO:106) or (Gly$_4$ Ser)$_3$ (SEQ ID NO:107). In another embodiment, the linkers include multiple repeats of (Gly$_2$Ser), (GlySer) or (Gly$_3$Ser) (SEQ ID NO:108). Also included within the scope of the invention are linkers described in WO2012/138475, incorporated herein by reference.

As used herein, a 5' cap (also termed an RNA cap, an RNA 7-methylguanosine cap or an RNA m$^7$G cap) is a modified guanine nucleotide that has been added to the "front" or 5' end of a eukaryotic messenger RNA shortly after the start of transcription. The 5' cap consists of a terminal group which is linked to the first transcribed nucleotide. Its presence is important for recognition by the ribosome and protection from RNases. Cap addition is coupled to transcription, and occurs co-transcriptionally, such that each influences the other. Shortly after the start of transcription, the 5' end of the mRNA being synthesized is bound by a cap-synthesizing complex associated with RNA polymerase. This enzymatic complex catalyzes the chemical reactions that are required for mRNA capping. Synthesis proceeds as a multi-step biochemical reaction. The capping moiety can be modified to modulate functionality of mRNA such as its stability or efficiency of translation.

As used herein, "in vitro transcribed RNA" refers to RNA, e.g., mRNA, that has been synthesized in vitro. Generally, the in vitro transcribed RNA is generated from an in vitro transcription vector. The in vitro transcription vector comprises a template that is used to generate the in vitro transcribed RNA.

As used herein, a "poly(A)" is a series of adenosines attached by polyadenylation to the mRNA. In some embodiments of a construct for transient expression, the polyA is between 50 and 5000 (SEQ ID NO: 28), e.g., greater than 64, e.g., greater than 100, e.g., than 300 or 400. Poly(A) sequences can be modified chemically or enzymatically to modulate mRNA functionality such as localization, stability or efficiency of translation.

As used herein, "polyadenylation" refers to the covalent linkage of a polyadenylyl moiety, or its modified variant, to a messenger RNA molecule. In eukaryotic organisms, most messenger RNA (mRNA) molecules are polyadenylated at the 3' end. The 3' poly(A) tail is a long sequence of adenine nucleotides (often several hundred) added to the pre-mRNA through the action of an enzyme, polyadenylate polymerase. In higher eukaryotes, the poly(A) tail is added onto transcripts that contain a specific sequence, the polyadenylation signal. The poly(A) tail and the protein bound to it aid in protecting mRNA from degradation by exonucleases. Polyadenylation is also important for transcription termination, export of the mRNA from the nucleus, and translation. Polyadenylation occurs in the nucleus immediately after transcription of DNA into RNA, but additionally can also occur later in the cytoplasm. After transcription has been terminated, the mRNA chain is cleaved through the action of an endonuclease complex associated with RNA polymerase. The cleavage site is usually characterized by the presence of the base sequence AAUAAA near the cleavage site. After the mRNA has been cleaved, adenosine residues are added to the free 3' end at the cleavage site.

As used herein, "transient" refers to expression of a non-integrated transgene for a period of hours, days or weeks, wherein the period of time of expression is less than the period of time for expression of the gene if integrated into the genome or contained within a stable plasmid replicon in the host cell.

The term "signal transduction pathway" refers to the biochemical relationship between a variety of signal transduction molecules that play a role in the transmission of a signal from one portion of a cell to another portion of a cell. The phrase "cell surface receptor" includes molecules and complexes of molecules capable of receiving a signal and transmitting signal across the membrane of a cell.

The term "subject" is intended to include living organisms in which an immune response can be elicited (e.g., mammals, human).

The term, a "substantially purified" cell refers to a cell that is essentially free of other cell types. A substantially purified cell also refers to a cell which has been separated from other cell types with which it is normally associated in its naturally occurring state. In some instances, a population of substantially purified cells refers to a homogenous population of cells. In other instances, this term refers simply to cell that have been separated from the cells with which they are naturally associated in their natural state. In some aspects, the cells are cultured in vitro. In other aspects, the cells are not cultured in vitro.

The term "therapeutic" as used herein means a treatment. A therapeutic effect is obtained by reduction, suppression, remission, or eradication of a disease state.

The term "prophylaxis" as used herein means the prevention of or protective treatment for a disease or disease state.

In the context of the present invention, "tumor antigen" or "hyperproliferative disorder antigen" or "antigen associated with a hyperproliferative disorder" refers to antigens that are common to specific hyperproliferative disorders. In certain aspects, the hyperproliferative disorder antigens of the present invention are derived from, cancers including but not limited to primary or metastatic melanoma, thymoma, lymphoma, sarcoma, lung cancer, liver cancer, non-Hodgkin lymphoma, Hodgkin lymphoma, leukemias, uterine cancer, cervical cancer, bladder cancer, kidney cancer and adenocarcinomas such as breast cancer, prostate cancer, ovarian cancer, pancreatic cancer, and the like.

The term "transfected" or "transformed" or "transduced" refers to a process by which exogenous nucleic acid is transferred or introduced into the host cell. A "transfected" or "transformed" or "transduced" cell is one which has been transfected, transformed or transduced with exogenous nucleic acid. The cell includes the primary subject cell and its progeny.

A subject "responds" to treatment if a parameter of a cancer (e.g., a hematological cancer, e.g., cancer cell growth, proliferation and/or survival) in the subject is retarded or reduced by a detectable amount, e.g., about 5%, 10%, 20%, 30%, 40%, 50%, 60%, 70%, 80%, 90% or more as determined by any appropriate measure, e.g., by mass, cell count or volume. In one example, a subject responds to treatment if the subject experiences a life expectancy extended by about 5%, 10%, 20%, 30%, 40%, 50% or more beyond the life expectancy predicted if no treatment is administered. In another example, a subject responds to treatment, if the subject has an increased disease-free survival, overall survival or increased time to progression. Several methods can be used to determine if a patient responds to a treatment including, for example, criteria provided by NCCN Clinical Practice Guidelines in Oncology (NCCN Guidelines®). For example, in the context of B-ALL, a complete response or complete responder, may involve one or more of: <5% BM blast, >1000 neutrophil/ANC (/μL). >100,000 platelets (/μL) with no circulating blasts or extramedullary disease (no lymphadenopathy, splenomegaly, skin/gum infiltration/testicular mass/CNS involvement), Trilineage hematopoiesis, and no recurrence for 4 weeks. A partial responder may involve one or more of >50% reduction in BM blast, >1000 neutrophil/ANC (/μL). >100,000 platelets (/μL). A non-responder can show disease progression, e.g., >25% in BM blasts.

"Refractory" as used herein refers to a disease, e.g., cancer, that does not respond to a treatment. In embodiments, a refractory cancer can be resistant to a treatment before or at the beginning of the treatment. In other embodiments, the refractory cancer can become resistant during a treatment. A refractory cancer is also called a resistant cancer.

The term "relapse" as used herein refers to reappearance of a cancer after an initial period of responsiveness (e.g., complete response or partial response). The initial period of responsiveness may involve the level of cancer cells falling below a certain threshold, e.g., below 20%, 1%, 10%, 5%, 4%, 3%, 2%, or 1%. The reappearance may involve the level of cancer cells rising above a certain threshold, e.g., above 20%, 1%, 10%, 5%, 4%, 3%, 2%, or 1%. For example, e.g., in the context of B-ALL, the reappearance may involve, e.g., a reappearance of blasts in the blood, bone marrow (>5%), or any extramedullary site, after a complete response. A complete response, in this context, may involve <5% BM blast. More generally, in an embodiment, a response (e.g., complete response or partial response) can involve the absence of detectable MRD (minimal residual disease). In an embodiment, the initial period of responsiveness lasts at least 1, 2, 3, 4, 5, or 6 days; at least 1, 2, 3, or 4 weeks; at least 1, 2, 3, 4, 6, 8, 10, or 12 months; or at least 1, 2, 3, 4, or 5 years.

In some embodiments, a therapy that includes a CD19 inhibitor, e.g., a CD19 CAR therapy, may relapse or be refractory to treatment. The relapse or resistance can be caused by CD19 loss (e.g., an antigen loss mutation) or other CD19 alteration that reduces the level of CD19 (e.g., caused by clonal selection of CD19-negative clones). A cancer that harbors such CD19 loss or alteration is referred to herein as a "CD19-negative cancer" or a "CD19-negative relapsed cancer"). It shall be understood that a CD19-negative cancer need not have 100% loss of CD19, but a sufficient reduction to reduce the effectiveness of a CD19 therapy such that the cancer relapses or becomes refractory. In some embodiments, a CD19-negative cancer results from a CD19 CAR therapy.

The term "specifically binds," refers to an antibody, or a ligand, which recognizes and binds with a binding partner (e.g., a stimulatory tumor antigen) protein present in a sample, but which antibody or ligand does not substantially recognize or bind other molecules in the sample.

As used herein, the term "pharmaceutically acceptable salt" refers to those salts which are, within the scope of sound medical judgment, suitable for use in contact with the tissues of subjects without undue toxicity, irritation, allergic response and the like, and are commensurate with a reasonable benefit/risk ratio. Pharmaceutically acceptable salts are well known in the art. For example, Berge et al. describes pharmaceutically acceptable salts in detail in *J. Pharmaceutical Sciences* (1977) 66:1-19.

"Regulatable chimeric antigen receptor (RCAR)," as that term is used herein, refers to a set of polypeptides, typically two in the simplest embodiments, which when in a RCARX cell, provides the RCARX cell with specificity for a target cell, typically a cancer cell, and with regulatable intracellular signal generation or proliferation, which can optimize an immune effector property of the RCARX cell. An RCARX cell relies at least in part, on an antigen binding domain to provide specificity to a target cell that comprises the antigen bound by the antigen binding domain. In an embodiment, an RCAR includes a dimerization switch that, upon the presence of a dimerization molecule, can couple an intracellular signaling domain to the antigen binding domain.

"Membrane anchor" or "membrane tethering domain", as that term is used herein, refers to a polypeptide or moiety, e.g., a myristoyl group, sufficient to anchor an extracellular or intracellular domain to the plasma membrane.

"Switch domain," as that term is used herein, e.g., when referring to an RCAR, refers to an entity, typically a polypeptide-based entity, that, in the presence of a dimerization molecule, associates with another switch domain. The association results in a functional coupling of a first entity linked to, e.g., fused to, a first switch domain, and a second entity linked to, e.g., fused to, a second switch domain. A first and second switch domain are collectively referred to as a dimerization switch. In embodiments, the first and second switch domains are the same as one another, e.g., they are polypeptides having the same primary amino acid sequence, and are referred to collectively as a homodimerization switch. In embodiments, the first and second switch domains are different from one another, e.g., they are polypeptides having different primary amino acid sequences, and are referred to collectively as a heterodimerization switch. In embodiments, the switch is intracellular. In embodiments, the switch is extracellular. In embodiments, the switch domain is a polypeptide-based entity, e.g., FKBP or FRB-based, and the dimerization molecule is small molecule, e.g., a rapalogue. In embodiments, the switch domain is a polypeptide-based entity, e.g., an scFv that binds a myc peptide, and the dimerization molecule is a polypeptide, a fragment thereof, or a multimer of a polypeptide, e.g., a myc ligand or multimers of a myc ligand that bind to one or more myc scFvs. In embodiments, the switch domain is a polypeptide-based entity, e.g., myc receptor, and the dimerization molecule is an antibody or fragments thereof, e.g., myc antibody.

"Dimerization molecule," as that term is used herein, e.g., when referring to an RCAR, refers to a molecule that promotes the association of a first switch domain with a second switch domain. In embodiments, the dimerization molecule does not naturally occur in the subject, or does not occur in concentrations that would result in significant dimerization. In embodiments, the dimerization molecule is a small molecule, e.g., rapamycin or a rapalogue, e.g., RAD001.

The term "low, immune enhancing, dose" when used in conjunction with an mTOR inhibitor, e.g., an allosteric mTOR inhibitor, e.g., RAD001 or rapamycin, or a catalytic mTOR inhibitor, refers to a dose of mTOR inhibitor that partially, but not fully, inhibits mTOR activity, e.g., as measured by the inhibition of P70 S6 kinase activity. Methods for evaluating mTOR activity, e.g., by inhibition of P70 S6 kinase, are discussed herein. The dose is insufficient to result in complete immune suppression but is sufficient to enhance the immune response. In an embodiment, the low, immune enhancing, dose of mTOR inhibitor results in a decrease in the number of PD-1 positive T cells and/or an increase in the number of PD-1 negative T cells, or an increase in the ratio of PD-1 negative T cells/PD-1 positive T cells. In an embodiment, the low, immune enhancing, dose of mTOR inhibitor results in an increase in the number of naive T cells. In an embodiment, the low, immune enhancing, dose of mTOR inhibitor results in one or more of the following:

an increase in the expression of one or more of the following markers: $CD62L^{high}$, $CD127^{high}$, $CD27^+$, and BCL2, e.g., on memory T cells, e.g., memory T cell precursors;

a decrease in the expression of KLRG1, e.g., on memory T cells, e.g., memory T cell precursors; and an increase in the number of memory T cell precursors, e.g., cells with any one or combination of the following characteristics: increased $CD62L^{high}$, increased $CD127^{high}$, increased $CD27^+$, decreased KLRG1, and increased BCL2; wherein any of the changes described above occurs, e.g., at least transiently, e.g., as compared to a non-treated subject.

Ranges: throughout this disclosure, various aspects of the invention can be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 2.7, 3, 4, 5, 5.3, and 6. As another example, a range such as 95-99% identity, includes something with 95%, 96%, 97%, 98% or 99% identity, and includes subranges such as 96-99%, 96-98%, 96-97%, 97-99%, 97-98% and 98-99% identity. This applies regardless of the breadth of the range.

Description

CD19 Inhibitors and Binding Domains

Provided herein are compositions of matter and methods of use for the treatment of a disease such as cancer using CD19 chimeric antigen receptors (CAR). The methods include, inter alia, administering a CD19 CAR described herein in combination with another agent such as B-cell inhibitor. The methods also include, e.g., administering a CD19 CAR described herein to treat a lymphoma such as Hodgkin lymphoma.

In one aspect, the invention provides a number of chimeric antigen receptors (CAR) comprising an antibody or antibody fragment engineered for specific binding to a CD19 protein. In one aspect, the invention provides a cell (e.g., T cell) engineered to express a CAR, wherein the CAR T cell ("CART") exhibits an anticancer property. In one aspect a cell is transformed with the CAR and the CAR is expressed on the cell surface. In some embodiments, the cell (e.g., T cell) is transduced with a viral vector encoding a CAR. In some embodiments, the viral vector is a retroviral vector. In some embodiments, the viral vector is a lentiviral vector. In some such embodiments, the cell may stably express the CAR. In another embodiment, the cell (e.g., T cell) is transfected with a nucleic acid, e.g., mRNA, cDNA, DNA, encoding a CAR. In some such embodiments, the cell may transiently express the CAR.

In one aspect, the anti-CD19 protein binding portion of the CAR is a scFv antibody fragment. In one aspect such antibody fragments are functional in that they retain the equivalent binding affinity, e.g., they bind the same antigen with comparable affinity, as the IgG antibody from which it is derived. In one aspect such antibody fragments are functional in that they provide a biological response that can include, but is not limited to, activation of an immune response, inhibition of signal-transduction origination from its target antigen, inhibition of kinase activity, and the like, as will be understood by a skilled artisan. In one aspect, the anti-CD19 antigen binding domain of the CAR is a scFv antibody fragment that is humanized compared to the murine sequence of the scFv from which it is derived. In one aspect, the parental murine scFv sequence is the CAR19 construct provided in PCT publication WO2012/079000 and provided herein as SEQ ID NO:59. In one embodiment, the anti-CD19 binding domain is a scFv described in WO2012/079000 and provided in SEQ ID NO:59, or a sequence at least 95%, e.g., 95-99%, identical thereto. In an embodiment, the anti-CD19 binding domain is part of a CAR construct provided in PCT publication WO2012/079000 and provided herein as SEQ ID NO:58, or a sequence at least 95%, e.g., 95%-99%, identical thereto. In an embodiment, the anti-CD19 binding domain comprises at least one (e.g., 2, 3, 4, 5, or 6) CDRs selected from Table 4 and/or Table 5.

In some aspects, the antibodies of the invention are incorporated into a chimeric antigen receptor (CAR). In one aspect, the CAR comprises the polypeptide sequence provided as SEQ ID NO: 12 in PCT publication WO2012/079000, and provided herein as SEQ ID NO: 58, wherein the scFv domain is substituted by one or more sequences selected from SEQ ID NOS: 1-12. In one aspect, the scFv domains of SEQ ID NOS:1-12 are humanized variants of the scFv domain of SEQ ID NO:59, which is an scFv fragment of murine origin that specifically binds to human CD19.

Humanization of this mouse scFv may be desired for the clinical setting, where the mouse-specific residues may induce a human-anti-mouse antigen (HAMA) response in patients who receive CART19 treatment, e.g., treatment with T cells transduced with the CAR19 construct.

In one aspect, the anti-CD19 binding domain, e.g., humanized scFv, portion of a CAR of the invention is encoded by a transgene whose sequence has been codon optimized for expression in a mammalian cell. In one aspect, entire CAR construct of the invention is encoded by a transgene whose entire sequence has been codon optimized for expression in a mammalian cell. Codon optimization refers to the discovery that the frequency of occurrence of synonymous codons (i.e., codons that code for the same amino acid) in coding DNA is biased in different species. Such codon degeneracy allows an identical polypeptide to be encoded by a variety of nucleotide sequences. A variety of codon optimization methods is known in the art, and include, e.g., methods disclosed in at least U.S. Pat. Nos. 5,786,464 and 6,114,148.

In one aspect, the humanized CAR19 comprises the scFv portion provided in SEQ ID NO:1. In one aspect, the humanized CAR19 comprises the scFv portion provided in SEQ ID NO:2. In one aspect, the humanized CAR19 comprises the scFv portion provided in SEQ ID NO:3. In one aspect, the humanized CAR19 comprises the scFv portion provided in SEQ ID NO:4. In one aspect, the humanized CAR19 comprises the scFv portion provided in SEQ ID NO:5. In one aspect, the humanized CAR19 comprises the scFv portion provided in SEQ ID NO:6. In one aspect, the humanized CAR19 comprises the scFv portion provided in SEQ ID NO:7. In one aspect, the humanized CAR19 comprises the scFv portion provided in SEQ ID NO:8. In one aspect, the humanized CAR19 comprises the scFv portion provided in SEQ ID NO:9. In one aspect, the humanized CAR19 comprises the scFv portion provided in SEQ ID NO:10. In one aspect, the humanized CAR19 comprises the scFv portion provided in SEQ ID NO:11. In one aspect, the humanized CAR19 comprises the scFv portion provided in SEQ ID NO:12.

In one aspect, the CARs of the invention combine an antigen binding domain of a specific antibody with an intracellular signaling molecule. For example, in some aspects, the intracellular signaling molecule includes, but is not limited to, CD3-zeta chain, 4-1BB and CD28 signaling modules and combinations thereof. In one aspect, the CD19 CAR comprises a CAR selected from the sequence provided in one or more of SEQ ID NOS: 31-42. In one aspect, the CD19 CAR comprises the sequence provided in SEQ ID NO:31. In one aspect, the CD19 CAR comprises the sequence provided in SEQ ID NO:32. In one aspect, the CD19 CAR comprises the sequence provided in SEQ ID NO:33. In one aspect, the CD19 CAR comprises the sequence provided in SEQ ID NO:34. In one aspect, the CD19 CAR comprises the sequence provided in SEQ ID NO:35. In one aspect, the CD19 CAR comprises the sequence provided in SEQ ID NO:36. In one aspect, the CD19 CAR comprises the sequence provided in SEQ ID NO:37. In one aspect, the CD19 CAR comprises the sequence provided in SEQ ID NO:38. In one aspect, the CD19 CAR comprises the sequence provided in SEQ ID NO:39. In one aspect, the CD19 CAR comprises the sequence provided in SEQ ID NO:40. In one aspect, the CD19 CAR comprises the sequence provided in SEQ ID NO:41. In one aspect, the CD19 CAR comprises the sequence provided in SEQ ID NO:42.

Thus, in one aspect, the antigen binding domain comprises a humanized antibody or an antibody fragment. In one embodiment, the humanized anti-CD19 binding domain comprises one or more (e.g., all three) light chain complementary determining region 1 (LC CDR1), light chain complementary determining region 2 (LC CDR2), and light chain complementary determining region 3 (LC CDR3) of a murine or humanized anti-CD19 binding domain described herein, and/or one or more (e.g., all three) heavy chain complementary determining region 1 (HC CDR1), heavy chain complementary determining region 2 (HC CDR2), and heavy chain complementary determining region 3 (HC CDR3) of a murine or humanized anti-CD19 binding domain described herein, e.g., a humanized anti-CD19 binding domain comprising one or more, e.g., all three, LC CDRs and one or more, e.g., all three, HC CDRs. In one embodiment, the humanized anti-CD19 binding domain comprises one or more (e.g., all three) heavy chain complementary determining region 1 (HC CDR1), heavy chain complementary determining region 2 (HC CDR2), and heavy chain complementary determining region 3 (HC CDR3) of a murine or humanized anti-CD19 binding domain described herein, e.g., the humanized anti-CD19 binding domain has two variable heavy chain regions, each comprising a HC CDR1, a HC CDR2 and a HC CDR3 described herein. In one embodiment, the humanized anti-CD19 binding domain comprises a humanized light chain variable region described herein (e.g., in Table 2) and/or a humanized heavy chain variable region described herein (e.g., in Table 2). In one embodiment, the humanized anti-CD19 binding domain comprises a humanized heavy chain variable region described herein (e.g., in Table 2), e.g., at least two humanized heavy chain variable regions described herein (e.g., in Table 2). In one embodiment, the anti-CD19 binding domain is a scFv comprising a light chain and a heavy chain of an amino acid sequence of Table 2. In an embodiment, the anti-CD19 binding domain (e.g., an scFv) comprises: a light chain variable region comprising an amino acid sequence having at least one, two or three modifications (e.g., substitutions) but not more than 30, 20 or 10 modifications (e.g., substitutions) of an amino acid sequence of a light chain variable region provided in Table 2, or a sequence with 95-99% identity with an amino acid sequence of Table 2; and/or a heavy chain variable region comprising an amino acid sequence having at least one, two or three modifications (e.g., substitutions) but not more than 30, 20 or 10 modifications (e.g., substitutions) of an amino acid sequence of a heavy chain variable region provided in Table 2, or a sequence with 95-99% identity to an amino acid sequence of Table 2. In one embodiment, the humanized anti-CD19 binding domain comprises a sequence selected from a group consisting of SEQ ID NO:1, SEQ ID NO:2, SEQ ID NO:3, SEQ ID NO:4, SEQ ID NO:5, SEQ ID NO:6, SEQ ID NO:7, SEQ ID NO:8, SEQ ID NO:9, SEQ ID NO:10, SEQ ID NO:11, and SEQ ID NO:12, or a sequence with 95-99% identity thereof. In one embodiment, the nucleic acid sequence encoding the humanized anti-CD19 binding domain comprises a sequence selected from a group consisting of SEQ ID NO:61, SEQ ID NO:62, SEQ ID NO:63, SEQ ID NO:64, SEQ ID NO:65, SEQ ID NO:66, SEQ ID NO:67, SEQ ID NO:68, SEQ ID NO:70, SEQ ID NO:71 and SEQ ID NO:72, or a sequence with 95-99% identity thereof. In one embodiment, the humanized anti-CD19 binding domain is a scFv, and a light chain variable region comprising an amino acid sequence described herein, e.g., in Table 2, is attached to a heavy chain variable region comprising an amino acid sequence described herein, e.g., in Table 2, via a linker, e.g., a linker described herein. In one embodiment, the humanized anti-CD19 binding domain includes a (Gly$_4$-Ser)n linker, wherein n is 1, 2, 3, 4, 5, or 6, e.g., 3 or 4 (SEQ ID NO:53). The light chain variable region and heavy chain variable region of a scFv can be, e.g., in any of the following orientations: light chain variable region-linker-heavy chain variable region or heavy chain variable region-linker-light chain variable region.

In one aspect, the antigen binding domain portion comprises one or more sequence selected from SEQ ID NOS: 1-12. In one aspect the humanized CAR is selected from one or more sequence selected from SEQ ID NOS: 31-42. In some aspects, a non-human antibody is humanized, where specific sequences or regions of the antibody are modified to increase similarity to an antibody naturally produced in a human or fragment thereof.

In one embodiment, the CAR molecule comprises an anti-CD19 binding domain comprising one or more (e.g., all three) light chain complementary determining region 1 (LC CDR1), light chain complementary determining region 2 (LC CDR2), and light chain complementary determining region 3 (LC CDR3) of an anti-CD19 binding domain described herein, and one or more (e.g., all three) heavy chain complementary determining region 1 (HC CDR1), heavy chain complementary determining region 2 (HC CDR2), and heavy chain complementary determining region 3 (HC CDR3) of an anti-CD19 binding domain described herein, e.g., an anti-CD19 binding domain comprising one or more, e.g., all three, LC CDRs and one or more, e.g., all three, HC CDRs. In one embodiment, the anti-CD19 binding domain comprises one or more (e.g., all three) heavy chain complementary determining region 1 (HC CDR1), heavy chain complementary determining region 2 (HC CDR2), and heavy chain complementary determining region 3 (HC CDR3) of an anti-CD19 binding domain described herein, e.g., the anti-CD19 binding domain has two variable heavy chain regions, each comprising a HC CDR1, a HC CDR2 and a HC CDR3 described herein.

In one aspect, the anti-CD19 binding domain is characterized by particular functional features or properties of an antibody or antibody fragment. For example, in one aspect, the portion of a CAR composition of the invention that comprises an antigen binding domain specifically binds human CD19. In one aspect, the invention relates to an antigen binding domain comprising an antibody or antibody fragment, wherein the antibody binding domain specifically binds to a CD19 protein or fragment thereof, wherein the antibody or antibody fragment comprises a variable light chain and/or a variable heavy chain that includes an amino acid sequence of SEQ ID NO: 1-12 or SEQ ID NO:59. In one aspect, the antigen binding domain comprises an amino acid sequence of an scFv selected from SEQ ID NOs: 1-12 or SEQ ID NO:59. In certain aspects, the scFv is contiguous with and in the same reading frame as a leader sequence. In one aspect the leader sequence is the polypeptide sequence provided as SEQ ID NO:13.

In one aspect, the portion of the CAR comprising the antigen binding domain comprises an antigen binding domain that targets CD19. In one aspect, the antigen binding domain targets human CD19. In one aspect, the antigen binding domain of the CAR has the same or a similar binding specificity as, or includes, the FMC63 scFv fragment described in Nicholson et al. Mol. Immun. 34 (16-17): 1157-1165 (1997). In one aspect, the portion of the CAR comprising the antigen binding domain comprises an antigen binding domain that targets a B-cell antigen, e.g., a human B-cell antigen. A CD19 antibody molecule can be, e.g., an antibody molecule (e.g., a humanized anti-CD19 antibody molecule) described in WO2014/153270, which is incorporated herein by reference in its entirety. WO2014/153270 also describes methods of assaying the binding and efficacy of various CART constructs.

In one embodiment, the anti-CD19 binding domain comprises a murine light chain variable region described herein (e.g., in Table 3) and/or a murine heavy chain variable region described herein (e.g., in Table 3). In one embodiment, the anti-CD19 binding domain is a scFv comprising a murine light chain and a murine heavy chain of an amino acid sequence of Table 3. In an embodiment, the anti-CD19 binding domain (e.g., an scFv) comprises: a light chain variable region comprising an amino acid sequence having at least one, two or three modifications (e.g., substitutions) but not more than 30, 20 or 10 modifications (e.g., substitutions) of an amino acid sequence of a light chain variable region provided in Table 3, or a sequence with 95-99% identity with an amino acid sequence of Table 3; and/or a heavy chain variable region comprising an amino acid sequence having at least one, two or three modifications (e.g., substitutions) but not more than 30, 20 or 10 modifications (e.g., substitutions) of an amino acid sequence of a heavy chain variable region provided in Table 3, or a sequence with 95-99% identity to an amino acid sequence of Table 3. In one embodiment, the anti-CD19 binding domain comprises a sequence of SEQ ID NO:59, or a sequence with 95-99% identity thereof. In one embodiment, the anti-CD19 binding domain is a scFv, and a light chain variable region comprising an amino acid sequence described herein, e.g., in Table 3, is attached to a heavy chain variable region comprising an amino acid sequence described herein, e.g., in Table 3, via a linker, e.g., a linker described herein. In one embodiment, the antigen binding domain includes a (Gly$_4$-Ser)n linker, wherein n is 1, 2, 3, 4, 5, or 6, e.g., 3 or 4 (SEQ ID NO: 53). The light chain variable region and heavy chain variable region of a scFv can be, e.g., in any of the following orientations: light chain variable region-linker-heavy chain variable region or heavy chain variable region-linker-light chain variable region.

Furthermore, the present invention provides (among other things) CD19 CAR compositions, optionally in combination with a B-cell inhibitor, and their use in medicaments or methods for treating, among other diseases, cancer or any malignancy or autoimmune diseases involving cells or tissues which express CD19.

In one aspect, the CAR of the invention can be used to eradicate CD19-expressing normal cells, thereby applicable for use as a cellular conditioning therapy prior to cell transplantation. In one aspect, the CD19-expressing normal cell is a CD19-expressing normal stem cell and the cell transplantation is a stem cell transplantation.

In one aspect, the invention provides a cell (e.g., T cell) engineered to express a chimeric antigen receptor (CAR), wherein the CAR-expressing cell, e.g., CAR T cell ("CART") exhibits an anticancer property. A suitable antigen is CD19. In one aspect, the antigen binding domain of the CAR comprises a partially humanized anti-CD19 antibody fragment. In one aspect, the antigen binding domain of the CAR comprises a partially humanized anti-CD19 antibody fragment comprising an scFv. Accordingly, the invention provides (among other things) a CD19-CAR that comprises a humanized anti-CD19 binding domain and is engineered into an immune effector cell, e.g., a T cell or an NK cell, and methods of their use for adoptive therapy.

In one aspect, the CAR, e.g., CD19-CAR comprises at least one intracellular domain selected from the group of a CD137 (4-1BB) signaling domain, a CD28 signaling domain, a CD3zeta signal domain, and any combination thereof. In one aspect, the CAR, e.g., CD19-CAR comprises at least one intracellular signaling domain is from one or more co-stimulatory molecule(s) other than a CD137 (4-1BB) or CD28.

The present invention encompasses, but is not limited to, a recombinant DNA construct comprising sequences encoding a CAR, wherein the CAR comprises an antibody or antibody fragment that binds specifically to CD19, CD10, CD20, CD22, CD34, CD123, FLT-3, or ROR1, e.g., human CD19, CD10, CD20, CD22, CD34, CD123, FLT-3, or ROR1, wherein the sequence of the antibody fragment is contiguous with and in the same reading frame as a nucleic acid sequence encoding an intracellular signaling domain. The intracellular signaling domain can comprise a costimulatory signaling domain and/or a primary signaling domain, e.g., a zeta chain. The costimulatory signaling domain refers to a portion of the CAR comprising at least a portion of the intracellular domain of a costimulatory molecule. In one embodiment, the antigen binding domain is a murine antibody or antibody fragment described herein. In one embodiment, the antigen binding domain is a humanized antibody or antibody fragment.

In specific aspects, a CAR construct of the invention comprises a scFv domain selected from the group consisting of SEQ ID NOS:1-12 or an scFV domain of SEQ ID NO:59, wherein the scFv may be preceded by an optional leader sequence such as provided in SEQ ID NO: 13, and followed by an optional hinge sequence such as provided in SEQ ID NO:14 or SEQ ID NO:45 or SEQ ID NO:47 or SEQ ID NO:49, a transmembrane region such as provided in SEQ ID NO:15, an intracellular signalling domain that includes SEQ ID NO:16 or SEQ ID NO:51 and a CD3 zeta sequence that includes SEQ ID NO:17 or SEQ ID NO:43, wherein the domains are contiguous with and in the same reading frame to form a single fusion protein. Also included in the invention (among other things) is a nucleotide sequence that encodes the polypeptide of each of the scFv fragments selected from the group consisting of SEQ ID NO:1, SEQ ID NO:2, SEQ ID NO:3, SEQ ID NO:4, SEQ ID NO:5, SEQ ID NO:6, SEQ ID NO:7, SEQ ID NO:8, SEQ ID NO:9, SEQ ID NO:10, SEQ ID NO:11, SEQ ID NO:12 and SEQ ID NO:59. Also included in the invention (among other things) is a nucleotide sequence that encodes the polypeptide of each of the scFv fragments selected from the group consisting of SEQ ID NO:1, SEQ ID NO:2, SEQ ID NO:3, SEQ ID NO:4, SEQ ID NO:5, SEQ ID NO:6, SEQ ID NO:7, SEQ ID NO:8, SEQ ID NO:9, SEQ ID NO:10, SEQ ID NO:11, SEQ ID NO:12 and SEQ ID NO:59, and each of the domains of SEQ ID NOS: 13-17, plus an encoded CD19 CAR fusion protein of the invention. In one aspect an exemplary CD19 CAR constructs comprise an optional leader sequence, an extracellular antigen binding domain, a hinge, a transmembrane domain, and an intracellular stimulatory domain. In one aspect an exemplary CD19 CAR construct comprises an optional leader sequence, an extracellular antigen binding domain, a hinge, a transmembrane domain, an intracellular costimulatory domain and an intracellular stimulatory domain. In some embodiments, specific CD19 CAR constructs containing humanized scFv domains of the invention are provided as SEQ ID NOS: 31-42, or a murine scFv domain as provided as SEQ ID NO:59.

Full-length CAR sequences are also provided herein as SEQ ID NOS: 31-42 and 58, as shown in Table 2 and Table 3.

An exemplary leader sequence is provided as SEQ ID NO: 13. An exemplary hinge/spacer sequence is provided as SEQ ID NO: 14 or SEQ ID NO:45 or SEQ ID NO:47 or SEQ ID NO:49. An exemplary transmembrane domain sequence is provided as SEQ ID NO:15. An exemplary sequence of the intracellular signaling domain of the 4-1BB protein is provided as SEQ ID NO: 16. An exemplary sequence of the intracellular signaling domain of CD27 is provided as SEQ ID NO:51. An exemplary CD3zeta domain sequence is provided as SEQ ID NO: 17 or SEQ ID NO:43. These sequences may be used, e.g., in combination with an scFv that recognizes one or more of CD19, CD10, CD20, CD22, CD34, CD123, FLT-3, or ROR1.

Exemplary sequences of various scFv fragments and other CAR components are provided herein. It is noted that these CAR components (e.g., of SEQ ID NO: 121, or a sequence of Table 2, 3, 6, 11A, 11B, 16, or 25) without a leader sequence (e.g., without the amino acid sequence of SEQ ID NO: 13 or a nucleotide sequence of SEQ ID NO: 54), are also provided herein.

In embodiments, the CAR sequences described herein contain a Q/K residue change in the signal domain of the co-stimulatory domain derived from CD3zeta chain.

In one aspect, the present invention encompasses a recombinant nucleic acid construct comprising a nucleic acid molecule encoding a CAR, wherein the nucleic acid molecule comprises the nucleic acid sequence encoding an anti-CD19 binding domain, e.g., described herein, that is contiguous with and in the same reading frame as a nucleic acid sequence encoding an intracellular signaling domain. In one aspect, the anti-CD19 binding domain is selected from one or more of SEQ ID NOS:1-12 and 58. In one aspect, the anti-CD19 binding domain is encoded by a nucleotide residues 64 to 813 of the sequence provided in one or more of SEQ ID NOS:61-72 and 97. In one aspect, the anti-CD19 binding domain is encoded by a nucleotide residues 64 to 813 of SEQ ID NO:61. In one aspect, the anti-CD19 binding domain is encoded by a nucleotide residues 64 to 813 of SEQ ID NO:62. In one aspect, the anti-CD19 binding domain is encoded by a nucleotide residues 64 to 813 of SEQ ID NO:63. In one aspect, the anti-CD19 binding domain is encoded by a nucleotide residues 64 to 813 of SEQ ID NO:64. In one aspect, the anti-CD19 binding domain is encoded by a nucleotide residues 64 to 813 of SEQ ID NO:65. In one aspect, the anti-CD19 binding domain is encoded by a nucleotide residues 64 to 813 of SEQ ID NO:66. In one aspect, the anti-CD19 binding domain is encoded by a nucleotide residues 64 to 813 of SEQ ID NO:67. In one aspect, the anti-CD19 binding domain is encoded by a nucleotide residues 64 to 813 of SEQ ID NO:68. In one aspect, the anti-CD19 binding domain is encoded by a nucleotide residues 64 to 813 of SEQ ID NO:69. In one aspect, the anti-CD19 binding domain is encoded by a nucleotide residues 64 to 813 of SEQ ID NO:70. In one aspect, the anti-CD19 binding domain is encoded by a nucleotide residues 64 to 813 of SEQ ID NO:71. In one aspect, the anti-CD19 binding domain is encoded by a nucleotide residues 64 to 813 of SEQ ID NO:72.

Provided herein are CD19 inhibitors and combination therapies. In some embodiments, the CD19 inhibitor (e.g., a cell therapy or an antibody) is administered in combination with a B cell inhibitor, e.g., one or more inhibitors of CD10, CD19, CD20, CD22, CD34, CD123, FLT-3, or ROR1. A CD19 inhibitor includes but is not limited to a CD19 CAR-expressing cell, e.g., a CD19 CART cell, or an anti-CD19 antibody (e.g., an anti-CD19 mono- or bispecific antibody) or a fragment or conjugate thereof. In an embodiment, the CD19 inhibitor is administered in combination with a B-cell inhibitor, e.g., a CAR-expressing cell described herein.

Numerous CD19 CAR-expressing cells are described in this disclosure. For instance, in some embodiments, a CD19 inhibitor includes an anti-CD19 CAR-expressing cell, e.g., CART, e.g., a cell expressing an anti-CD19 CAR construct described in Table 2 or encoded by a CD19 binding CAR comprising a scFv, CDRs, or VH and VL chains described in Tables 2, 4, or 5. For example, an anti-CD19 CAR-expressing cell, e.g., CART, is a generated by engineering a CD19-CAR (that comprises a CD19 binding domain) into a cell (e.g., a T cell or NK cell), e.g., for administration in combination with a CAR-expressing cell described herein. Also provided herein are methods of use of the CAR-expressing cells described herein for adoptive therapy.

In one embodiment, an antigen binding domain comprises one, two three (e.g., all three) heavy chain CDRs, HC CDR1, HC CDR2 and HC CDR3, from an antibody listed herein, e.g., in Table 2, 4, or 5 and/or one, two, three (e.g., all three) light chain CDRs, LC CDR1, LC CDR2 and LC CDR3, from an antibody listed herein, e.g., in Table 2, 4, or 5. In one embodiment, the antigen binding domain comprises a heavy chain variable region and/or a variable light chain region of an antibody listed or described above.

In an embodiment, the CD19 binding domain (e.g., an scFv) comprises: a light chain variable region comprising an amino acid sequence having at least one, two or three modifications (e.g., substitutions) but not more than 30, 20 or 10 modifications (e.g., substitutions) of an amino acid sequence of a light chain variable region provided in Table 2, or a sequence with 95-99% identity with an amino acid sequence of Table 2; and/or a heavy chain variable region comprising an amino acid sequence having at least one, two or three modifications (e.g., substitutions) but not more than 30, 20 or 10 modifications (e.g., substitutions) of an amino acid sequence of a heavy chain variable region provided in Table 2, or a sequence with 95-99% identity to an amino acid sequence of Table 2. In embodiments, the CD19 binding domain comprises one or more CDRs (e.g., one each of a HC CDR1, HC CDR2, HC CDR3, LC CDR1, LC CDR2, and LC CDR3) of Table 4 or Table 5, or CDRs having one, two, three, four, five, or six modifications (e.g., substitutions) of one or more of the CDRs.

Exemplary anti-CD19 antibodies or fragments or conjugates thereof include but are not limited to blinatumomab, SAR3419 (Sanofi), MEDI-551 (MedImmune LLC), Combotox, DT2219ARL (Masonic Cancer Center), MOR-208 (also called XmAb-5574; MorphoSys), XmAb-5871 (Xencor), MDX-1342 (Bristol-Myers Squibb), SGN-CD19A (Seattle Genetics), and AFM11 (Affimed Therapeutics). See, e.g., Hammer. MAbs. 4.5(2012): 571-77. Blinatomomab is a bispecific antibody comprised of two scFvs—one that binds to CD19 and one that binds to CD3. Blinatomomab directs T cells to attack cancer cells. See, e.g., Hammer et al.; Clinical Trial Identifier No. NCT00274742 and NCT01209286. MEDI-551 is a humanized anti-CD19 antibody with a Fc engineered to have enhanced antibody-dependent cell-mediated cytotoxicity (ADCC). See, e.g., Hammer et al.; and Clinical Trial Identifier No. NCT01957579. Combotox is a mixture of immunotoxins that bind to CD19 and CD22. The immunotoxins are made up of scFv antibody fragments fused to a deglycosylated ricin A chain. See, e.g., Hammer et al.; and Herrera et al. J. Pediatr. Hematol. Oncol. 31.12(2009):936-41; Schindler et al. Br. J. Haematol. 154.4(2011):471-6. DT2219ARL is a bispecific immunotoxin targeting CD19 and CD22, comprising two scFvs and a truncated diphtheria toxin. See, e.g., Hammer et al.; and Clinical Trial Identifier No. NCT00889408. SGN-CD19A is an antibody-drug conjugate (ADC) comprised of an anti-CD19 humanized monoclonal antibody linked to a synthetic cytotoxic cell-killing agent, monomethyl auristatin F (MMAF). See, e.g., Hammer et al.; and Clinical Trial Identifier Nos. NCT01786096 and NCT01786135. SAR3419 is an anti-CD19 antibody-drug conjugate (ADC) comprising an anti-CD19 humanized monoclonal antibody conjugated to a maytansine derivative via a cleavable linker. See, e.g., Younes et al. J. Clin. Oncol. 30.2(2012): 2776-82; Hammer et al.; Clinical Trial Identifier No. NCT00549185; and Blanc et al. Clin Cancer Res. 2011; 17:6448-58. XmAb-5871 is an Fc-engineered, humanized anti-CD19 antibody. See, e.g., Hammer et al. MDX-1342 is a human Fc-engineered anti-CD19 antibody with enhanced ADCC. See, e.g., Hammer et al. In embodiments, the antibody molecule is a bispecific anti-CD19 and anti-CD3 molecule. For instance, AFM11 is a bispecific antibody that targets CD19 and CD3. See, e.g., Hammer et al.; and Clinical Trial Identifier No. NCT02106091. In some embodiments, an anti-CD19 antibody described herein is conjugated or otherwise bound to a therapeutic agent, e.g., a chemotherapeutic agent, peptide vaccine (such as that described in Izumoto et al. 2008 J Neurosurg 108:963-971), immunosuppressive agent, or immunoablative agent, e.g., cyclosporin, azathioprine, methotrexate, mycophenolate, FK506, CAMPATH, anti-CD3 antibody, cytoxin, fludarabine, rapamycin, mycophenolic acid, steroid, FR901228, or cytokine.

Exemplary anti-CD19 antibody molecules (including antibodies or fragments or conjugates thereof) can include a scFv, CDRs, or VH and VL chains described in Tables 2, 4, or 5. In an embodiment, the CD19-binding antibody molecule comprises: a light chain variable region comprising an amino acid sequence having at least one, two or three modifications (e.g., substitutions) but not more than 30, 20 or 10 modifications (e.g., substitutions) of an amino acid sequence of a light chain variable region provided in Table 2, or a sequence with 95-99% identity with an amino acid sequence of Table 2; and/or a heavy chain variable region comprising an amino acid sequence having at least one, two or three modifications (e.g., substitutions) but not more than 30, 20 or 10 modifications (e.g., substitutions) of an amino acid sequence of a heavy chain variable region provided in Table 2, or a sequence with 95-99% identity to an amino acid sequence of Table 2. In embodiments, the CD19-binding antibody molecule comprises one or more CDRs (e.g., one each of a HC CDR1, HC CDR2, HC CDR3, LC CDR1, LC CDR2, and LC CDR3) of Table 4 or Table 5, or CDRs having one, two, three, four, five, or six modifications (e.g., substitutions) of one or more of the CDRs. The antibody molecule may be, e.g., an isolated antibody molecule.

In one embodiment, an antigen binding domain against CD19 is an antigen binding portion, e.g., CDRs, of an antigen binding domain described in a Table herein. In one embodiment, a CD19 antigen binding domain can be from any CD19 CAR, e.g., LG-740; U.S. Pat. Nos. 8,399,645; 7,446,190; Xu et al., Leuk Lymphoma. 2013 54(2):255-260 (2012); Cruz et al., Blood 122(17):2965-2973 (2013); Brentjens et al., Blood, 118(18):4817-4828 (2011); Kochenderfer et al., Blood 116(20):4099-102 (2010); Kochenderfer et al., Blood 122 (25):4129-39(2013); and 16th Annu Meet Am Soc Gen Cell Ther (ASGCT) (May 15-18, Salt Lake City) 2013, Abst 10, each of which is herein incorporated by reference in its entirety.

In one embodiment, the CAR T cell that specifically binds to CD19 has the USAN designation TISAGENLECLEU-CEL-T. CTL019 is made by a gene modification of T cells is mediated by stable insertion via transduction with a self-inactivating, replication deficient Lentiviral (LV) vector containing the CTL019 transgene under the control of the EF-1 alpha promoter. CTL019 can be a mixture of transgene positive and negative T cells that are delivered to the subject on the basis of percent transgene positive T cells.

In one aspect the nucleic acid sequence of a CAR construct of the invention is selected from one or more of SEQ ID NOS:85-96. In one aspect the nucleic acid sequence of a CAR construct is SEQ ID NO:85. In one aspect the nucleic acid sequence of a CAR construct is SEQ ID NO:86. In one aspect the nucleic acid sequence of a CAR construct is SEQ ID NO:87. In one aspect the nucleic acid sequence of a CAR construct is SEQ ID NO:88. In one aspect the nucleic acid sequence of a CAR construct is SEQ ID NO:89. In one aspect the nucleic acid sequence of a CAR construct is SEQ ID NO:90. In one aspect the nucleic acid sequence of a CAR construct is SEQ ID NO:91. In one aspect the nucleic acid sequence of a CAR construct is SEQ ID NO:92. In one aspect the nucleic acid sequence of a CAR construct is SEQ ID NO:93. In one aspect the nucleic acid sequence of a CAR construct is SEQ ID NO:94. In one aspect the nucleic acid sequence of a CAR construct is SEQ ID NO:95. In one aspect the nucleic acid sequence of a CAR construct is SEQ ID NO:96. In one aspect the nucleic acid sequence of a CAR construct is SEQ ID NO:97. In one aspect the nucleic acid sequence of a CAR construct is SEQ ID NO:98. In one aspect the nucleic acid sequence of a CAR construct is SEQ ID NO:99.

CD20 Inhibitors and Binding Domains

As used herein, the term "CD20" refers to an antigenic determinant known to be detectable on B cells. Human CD20 is also called membrane-spanning 4-domains, subfamily A, member 1 (MS4A1). The human and murine amino acid and nucleic acid sequences can be found in a public database, such as GenBank, UniProt and Swiss-Prot. For example, the amino acid sequence of human CD20 can be found at Accession Nos. NP_690605.1 and NP_068769.2, and the nucleotide sequence encoding transcript variants 1 and 3 of the human CD20 can be found at Accession No. NM_152866.2 and NM_021950.3, respectively. As used herein, "CD20" includes proteins comprising mutations, e.g., point mutations, fragments, insertions, deletions and splice variants of full length wild-type CD20. In one aspect the antigen-binding portion of the CAR recognizes and binds an antigen within the extracellular domain of the CD20 protein. In one aspect, the CD20 protein is expressed on a cancer cell.

In some aspects, the present disclosure provides a CD20 inhibitor or binding domain, e.g., a CD20 inhibitor or binding domain as described herein. The disclosure also provides a nucleic acid encoding the CD20 binding domain, or a CAR comprising the CD20 binding domain. A CD20 inhibitor includes but is not limited to a CD20 CAR-expressing cell, e.g., a CD20 CART cell or an anti-CD20 antibody (e.g., an anti-CD20 mono- or bispecific antibody) or a fragment thereof. The composition may also comprise a second agent, e.g., an anti-CD19 CAR-expressing cell or a CD19 binding domain. The agents may be, e.g., encoded by a single nucleic acid or different nucleic acids.

In some aspects, a CD20 inhibitor or binding domain is administered as a monotherapy. In some aspects, the CD20 inhibitor or binding domain is administered in combination with a second agent such as an anti-CD19 CAR-expressing cell. In an embodiment, the CD20 inhibitor is administered in combination with a CD19 inhibitor, e.g., a CD19 CAR-expressing cell, e.g., a CAR-expressing cell described herein e.g., a cell expressing a CAR comprising an antibody binding domain that is murine, human, or humanized.

CD20 CAR-Expressing Cells, e.g., CARTs

In an embodiment, the CD20 antibody molecule comprises: a light chain variable region comprising an amino acid sequence having at least one, two or three modifications (e.g., substitutions) but not more than 30, 20 or 10 modifications (e.g., substitutions) of an amino acid sequence of a light chain variable region provided in Table 15A or 15B, or a sequence with 95-99% identity with an amino acid sequence of Table 15A or 15B; and/or a heavy chain variable region comprising an amino acid sequence having at least one, two or three modifications (e.g., substitutions) but not more than 30, 20 or 10 modifications (e.g., substitutions) of an amino acid sequence of a heavy chain variable region provided in Table 14A or 14B, or a sequence with 95-99% identity to an amino acid sequence of Table 14A or 14B. In one embodiment, the CD20 antibody molecule comprises one or more (e.g., two or all three) light chain complementary determining region 1 (LC CDR1), light chain complementary determining region 2 (LC CDR2), and light chain complementary determining region 3 (LC CDR3) of a CD20 binding domain described herein, and/or one or more (e.g., all three) heavy chain complementary determining region 1 (HC CDR1), heavy chain complementary determining region 2 (HC CDR2), and heavy chain complementary determining region 3 (HC CDR3) of a CD20 binding domain described herein, e.g., a CD20 binding domain comprising one or more, e.g., all three, LC CDRs and one or more, e.g., all three, HC CDRs. These CDRs may be, e.g., those of Table 12A, 12B, and/or Table 13, or a sequence substantially identical thereto. In an embodiment, the CD20 antibody molecule comprises one or more CDRs (e.g., a HC CDR1, HC CDR2, HC CDR3, LC CDR1, LC CDR2, or LC CDR3) comprising an amino acid sequence having one, two, three, four, five, or six modifications (e.g., substitutions) of an amino acid sequence of Table 12A, 12B, and/or Table 13. The antibody molecule may be, e.g., an isolated antibody molecule.

In some embodiments, a CD20 inhibitor includes an anti-CD20 CAR-expressing cell, e.g., CART, e.g., a cell expressing an anti-CD20 CAR construct described in Table 11A or 11B, or a sequence substantially identical thereto, or encoded by a CD20 binding CAR comprising a scFv, CDRs, or VH and VL chains described in Tables 11A-15B, or a sequence substantially identical thereto. For example, an anti-CD20 CAR-expressing cell, e.g., CART, is a generated by engineering a CD20-CAR (that comprises a CD20 binding domain) into a cell (e.g., a T cell or NK cell), e.g., for administration in combination with a CAR-expressing cell described herein. Also provided herein are methods of use of the CAR-expressing cells described herein for adoptive therapy.

In an embodiment, the CD20 binding domain (e.g., an scFv) comprises: a light chain variable region comprising an amino acid sequence having at least one, two or three modifications (e.g., substitutions) but not more than 30, 20 or 10 modifications (e.g., substitutions) of an amino acid sequence of a light chain variable region provided in Table 15A or 15B, or a sequence with 95-99% identity with an amino acid sequence of Table 15A or 15B; and/or a heavy chain variable region comprising an amino acid sequence having at least one, two or three modifications (e.g., substitutions) but not more than 30, 20 or 10 modifications (e.g., substitutions) of an amino acid sequence of a heavy chain variable region provided in Table 14A or 14B, or a sequence with 95-99% identity to an amino acid sequence of Table 14A or 14B.

In one embodiment, the CD20 binding domain comprises one or more (e.g., two or all three) light chain complementary determining region 1 (LC CDR1), light chain complementary determining region 2 (LC CDR2), and light chain complementary determining region 3 (LC CDR3) of a CD20 binding domain described herein, and/or one or more (e.g., all three) heavy chain complementary determining region 1 (HC CDR1), heavy chain complementary determining region 2 (HC CDR2), and heavy chain complementary determining region 3 (HC CDR3) of a CD20 binding domain described herein, e.g., a CD20 binding domain comprising one or more, e.g., all three, LC CDRs and one or more, e.g., all three, HC CDRs. These CDRs may be, e.g., those of Table 12A, 12B, and/or Table 13, or a sequence substantially identical thereto. In an embodiment, the CD20 binding domain (e.g., an scFv) comprises one or more CDRs (e.g., a HC CDR1, HC CDR2, HC CDR3, LC CDR1, LC CDR2, or LC CDR3) comprising an amino acid sequence having one, two, three, four, five, or six modifications (e.g., substitutions) of an amino acid sequence of Table 12A, 12B, and/or Table 13.

In some embodiments, the CAR comprises an antibody or antibody fragment which includes a CD20 binding domain, a transmembrane domain, and an intracellular signaling domain. The CD20 binding domain may comprise one or more of light chain complementary determining region 1 (LC CDR1), light chain complementary determining region 2 (LC CDR2), and light chain complementary determining region 3 (LC CDR3) of any CD20 light chain binding domain amino acid sequence listed in Table 13, 15A, or 15B, and one or more of heavy chain complementary determining region 1 (HC CDR1), heavy chain complementary determining region 2 (HC CDR2), and heavy chain complementary determining region 3 (HC CDR3) of any CD20 heavy chain binding domain amino acid sequence listed in Table 12A, 12B, 14A, or 14B.

In an embodiment, the CD20 binding domain comprises six CDRs (e.g., one each of a HC CDR1, HC CDR2, HC CDR3, LC CDR1, LC CDR2, and LC CDR3) of any one of CAR20-1, CAR20-2, CAR20-3, CAR20-4, CAR20-5, CAR20-6, CAR20-7, CAR20-8, CAR20-9, CAR20-10, CAR20-11, CAR20-12, CAR20-13, CAR20-14, CAR20-15, or CAR20-16, or a sequence substantially identical thereto. In an embodiment, the CD20 binding domain comprises three CDRs (e.g., one each of a HC CDR1, HC CDR2, and HC CDR3, or one each of a LC CDR1, LC CDR2, and LC CDR3) of any one of CAR20-1, CAR20-2, CAR20-3, CAR20-4, CAR20-5, CAR20-6, CAR20-7, CAR20-8, CAR20-9, CAR20-10, CAR20-11, CAR20-12, CAR20-13, CAR20-14, CAR20-15, or CAR20-16, or a sequence substantially identical thereto.

In one embodiment, the CD20 binding domain comprises a light chain variable region described herein (e.g., in Table 15A or 15B) and/or a heavy chain variable region described herein (e.g., in Table 14A or 14B), or a sequence substantially identical thereto. In an embodiment, the CD20 binding domain (e.g., an scFv) comprises: a light chain variable region comprising an amino acid sequence having at least one, two or three modifications (e.g., substitutions) but not more than 30, 20 or 10 modifications (e.g., substitutions) of an amino acid sequence of a light chain variable region provided in Table 15A or 15B, or a sequence with 95-99% identity with an amino acid sequence of Table 15A or 15B; and/or a heavy chain variable region comprising an amino acid sequence having at least one, two or three modifications (e.g., substitutions) but not more than 30, 20 or 10 modifications (e.g., substitutions) of an amino acid sequence of a heavy chain variable region provided in Table 14A or 14B, or a sequence with 95-99% identity to an amino acid sequence of Table 14A or 14B.

Further embodiments include a nucleotide sequence that encodes a polypeptide described in this section. For example, further embodiments include a nucleotide sequence that encodes a polypeptide of any of Tables 11A-15B. For instance, the nucleotide sequence can comprise a CAR construct or scFv of Table 11A or 11B. The nucleotide may encode a VH of Table 14A or 14B, a VL of Table 15A or 15B, or both. The nucleotide may encode one or more of (e.g., two or three of) a VH CDR1, VH CDR2, or VH CDR3 of Table 12A or 12B and/or the nucleotide may encode one or more of (e.g., two or three of) a VL CDR1, VL CDR2, or VL CDR3 of Table 13. The nucleotide sequence can also include one or more of, e.g., all of the domains of SEQ ID NOS: 13, 14, 15, 16, 17, and 51.

In another aspect, provided herein is a population of CAR-expressing cells, e.g., CART cells, comprising a mixture of cells expressing CD19 CARs and CD20 CARs. For example, in one embodiment, the population of CART cells can include a first cell expressing a CD19 CAR and a second cell expressing a CD20 CAR. In one embodiment, the population of CAR-expressing cells includes, e.g., a first cell expressing a CAR (e.g., a CD19 CAR, a ROR1 CAR, a CD20 CAR, or a CD22 CAR) that includes a primary intracellular signaling domain, and a second cell expressing a CAR (e.g., a CD19 CAR, a ROR1 CAR, a CD20 CAR, or a CD22 CAR)) that includes a secondary signaling domain.

The CD20 CAR may also comprise one or more of a a transmembrane domain, e.g., a transmembrane domain as described herein, an intracellular signaling domain, e.g., intracellular signaling domain as described herein, a costimulatory domain, e.g., a costimulatory domain as described herein, a leader sequence, e.g. a leader sequence as described herein, or a hinge, e.g., a hinge as described herein.

Exemplary anti-CD20 antibodies include but are not limited to rituximab, ofatumumab, ocrelizumab, veltuzumab, obinutuzumab, TRU-015 (Trubion Pharmaceuticals), ocaratuzumab, and Pro131921 (Genentech). See, e.g., Lim et al. Haematologica. 95.1(2010):135-43.

In some embodiments, the anti-CD20 antibody comprises rituximab. Rituximab is a chimeric mouse/human monoclonal antibody IgG1 kappa that binds to CD20 and causes cytolysis of a CD20 expressing cell, e.g., as described in www.accessdata.fda.gov/drugsatfda_docs/label/2010/103705s5311lbl.pdf. In some embodiments, rituximab can be used to treat B-cell malignancies, such as non-Hodgkin lymphoma (NHL) (e.g., follicular NHL, diffuse large B-cell lymphoma) and chronic lymphocytic leukemia (CLL). In other embodiments, rituximab can be used to treat autoimmune diseases, such as rheumatoid arthritis, multiple sclerosis, systemic lupus erythematosus, chronic inflammatory demyelinating polyneuropathy, autoimmune anemia, autoimmune hemolytic anemia, pure red cell aplasia, idiopathic thrombocytopenic purpura (ITP), Evans syndrome, vasculitis, bullous skin disorders, type 1 diabetes mellitus, Sjogren's syndrome, anti-NMDA receptor encephalitis and Devic's disease, Graves' ophthalmopathy, and autoimmune pancreatitis. In some embodiments, rituximab can be used to treat transplant rejection.

In some embodiments, rituximab is administered intravenously, e.g., as an intravenous infusion. For example, each infusion provides about 500-2000 mg (e.g., about 500-550, 550-600, 600-650, 650-700, 700-750, 750-800, 800-850, 850-900, 900-950, 950-1000, 1000-1100, 1100-1200, 1200-1300, 1300-1400, 1400-1500, 1500-1600, 1600-1700, 1700-1800, 1800-1900, or 1900-2000 mg) of rituximab.

In some embodiments, rituximab is administered at a dose of 150 mg/m$^2$ to 750 mg/m$^2$, e.g., about 150-175 mg/m$^2$, 175-200 mg/m$^2$, 200-225 mg/m$^2$, 225-250 mg/m$^2$, 250-300 mg/m$^2$, 300-325 mg/m$^2$, 325-350 mg/m$^2$, 350-375 mg/m$^2$, 375-400 mg/m$^2$, 400-425 mg/m$^2$, 425-450 mg/m$^2$, 450-475 mg/m$^2$, 475-500 mg/m$^2$, 500-525 mg/m$^2$, 525-550 mg/m$^2$, 550-575 mg/m$^2$, 575-600 mg/m$^2$, 600-625 mg/m$^2$, 625-650 mg/m$^2$, 650-675 mg/m$^2$, or 675-700 mg/m$^2$, where m$^2$ indicates the body surface area of the subject.

In some embodiments, rituximab is administered at a dosing interval of at least 4 days, e.g., 4, 7, 14, 21, 28, 35 days, or more. For example, rituximab is administered at a dosing interval of at least 0.5 weeks, e.g., 0.5, 1, 2, 3, 4, 5, 6, 7, 8 weeks, or more.

In some embodiments, rituximab is administered at a dose and dosing interval described herein for a period of time, e.g., at least 2 weeks, e.g., at least 2, 3, 4, 5, 6, 7, 8, 9, 10, 11, 12, 13, 14, 15, 16, 17, 18, 19, 20 weeks, or greater. For example, rituximab is administered at a dose and dosing interval described herein for a total of at least 4 doses per treatment cycle (e.g., at least 4, 5, 6, 7, 8, 9, 10, 11, 12, 13, 14, 15, 16, or more doses per treatment cycle).

In some aspects, the anti-CD20 antibody comprises ofatumumab. Ofatumumab is an anti-CD20 IgG1κ human monoclonal antibody with a molecular weight of approximately 149 kDa. For example, ofatumumab is generated using transgenic mouse and hybridoma technology and is expressed and purified from a recombinant murine cell line (NS0). See, e.g., www.accessdata.fda.gov/drugsatfd_docs/label/2009/125326lbl.pdf; and Clinical Trial Identifier number NCT01363128, NCT01515176, NCT01626352, and NCT01397591.

Ofatumumab can be used to treat diseases such as CLL, non-Hodgkin lymphoma (NHL) (e.g., follicular NHL and DLBCL), B-Cell Prolymphocytic Leukemia, Acute Lymphoblastic Leukemia (ALL), mantle cell lymphoma, rheumatoid arthritis, and multiple sclerosis.

In some embodiments, ofatumumab is administered as an intravenous infusion. For example, each infusion provides about 150-3000 mg (e.g., about 150-200, 200-250, 250-300, 300-350, 350-400, 400-450, 450-500, 500-550, 550-600, 600-650, 650-700, 700-750, 750-800, 800-850, 850-900, 900-950, 950-1000, 1000-1200, 1200-1400, 1400-1600, 1600-1800, 1800-2000, 2000-2200, 2200-2400, 2400-2600, 2600-2800, or 2800-3000 mg) of ofatumumab.

In some embodiments, ofatumumab is administered at a dosing interval of at least 4 days, e.g., 4, 7, 14, 21, 28, 35 days, or more. For example, ofatumumab is administered at a dosing interval of at least 1 week, e.g., 1, 2, 3, 4, 5, 6, 7, 8, 9, 10, 11, 12, 24, 26, 28, 20, 22, 24, 26, 28, 30 weeks, or more.

In some embodiments, ofatumumab is administered at a dose and dosing interval described herein for a period of time, e.g., at least 1 week, e.g., 1, 2, 3, 4, 5, 6, 7, 8, 9, 10, 11, 12, 13, 14, 15, 16, 17, 18, 19, 20, 22, 24, 26, 28, 30, 40, 50, 60 weeks or greater, or 1, 2, 3, 4, 5, 6, 7, 8, 9, 10, 11, 12 months or greater, or 1, 2, 3, 4, 5 years or greater. For example, ofatumumab is administered at a dose and dosing interval described herein for a total of at least 2 doses per treatment cycle (e.g., at least 2, 3, 4, 5, 6, 7, 8, 9, 10, 11, 12, 13, 14, 15, 16, 18, 20, or more doses per treatment cycle).

In some aspects, the anti-CD20 antibody comprises ocrelizumab. Ocrelizumab is a humanized anti-CD20 monoclonal antibody, e.g., as described in Clinical Trials Identifier Nos. NCT00077870, NCT01412333, NCT00779220, NCT00673920, NCT01194570, and Kappos et al. Lancet. 19.378(2011):1779-87. For example, ocrelizumab can be used to treat diseases such as rheumatoid arthritis, multiple sclerosis, and lupus.

In some embodiments, ocrelizumab is administered as an intravenous infusion. For example, each infusion provides about 50-2000 mg (e.g., about 50-100, 100-150, 150-200, 200-250, 250-300, 300-350, 350-400, 400-450, 450-500, 500-550, 550-600, 600-650, 650-700, 700-750, 750-800, 800-850, 850-900, 900-950, 950-1000, 1000-1100, 1100-1200, 1200-1300, 1300-1400, 1400-1500, 1500-1600, 1600-1700, 1700-1800, 1800-1900, or 1900-2000 mg) of ocrelizumab.

In some embodiments, ocrelizumab is administered at a dosing interval of at least 7 days, e.g., 7, 14, 21, 28, 35 days, or more. For example, ocrelizumab is administered at a dosing interval of at least 1 week, e.g., 1, 2, 3, 4, 5, 6, 7, 8, 9, 10, 11, 12, 24, 26, 28, 20, 22, 24, 26, 28, 30 weeks, or more.

In some embodiments, ocrelizumab is administered at a dose and dosing interval described herein for a period of time, e.g., at least 2 weeks, e.g., at least 2, 3, 4, 5, 6, 7, 8, 9, 10, 11, 12, 13, 14, 15, 16, 17, 18, 19, 20, 22, 24, 26, 28, 30, 40, 50, 60 weeks or greater, or 1, 2, 3, 4, 5, 6, 7, 8, 9, 10, 11, 12 months or greater, or 1, 2, 3, 4, 5 years or greater. For example, ocrelizumab is administered at a dose and dosing interval described herein for a total of at least 4 doses per treatment cycle (e.g., at least 4, 5, 6, 7, 8, 9, 10, 11, 12, 13, 14, 15, 16, 18, 20, or more doses per treatment cycle).

In some aspects, the anti-CD20 antibody comprises veltuzumab. Veltuzumab is a humanized monoclonal antibody against CD20. See, e.g., Clinical Trial Identifier No. NCT00547066, NCT00546793, NCT01101581, and Goldenberg et al, Leuk Lymphoma. 51(5)(2010):747-55. For example, veltuzumab can be used to treat NHL (e.g., DLBCL, follicular lymphoma), CLL, and autoimmune diseases such as Immune Thrombocytopenic Purpura (ITP).

In some embodiments, veltuzumab is administered subcutaneously or intravenously, e.g., as an intravenous infusion. In some embodiments, veltuzumab is administered at a dose of 50-800 mg/m$^2$, e.g., about 50-60, 60-70, 70-80, 80-90, 90-100, 100-110, 110-120, 120-130, 130-140, 140-150, 150-160, 160-170, 170-180, 180-190, 190-200, 200-225, 225-250, 250-275, 275-300, 300-325, 325-350, 350-375, 375-400, 400-425, 425-450, 450-475, 475-500, 500-525, 525-550, 550-575, 575-600, 600-625, 625-650, 650-675, 675-700, 700-725, 725-750, 750-775, or 775-800 mg/m$^2$. In some embodiments, a dose of 50-400 mg, e.g., 50, 75, 100, 125, 150, 175, 200, 225, 250, 275, 300, 325, 350, 375, or 400 mg of veltuzumab is administered.

In some embodiments, veltuzumab is administered at a dosing interval of at least 7 days, e.g., 7, 14, 21, 28, 35 days, or more. For example, veltuzumab is administered at a dosing interval of at least 1 week, e.g., 1, 2, 3, 4, 5, 6, 7, 8, 9, 10, 11, 12, 24, 26, 28, 20, 22, 24, 26, 28, 30 weeks, or more.

In some embodiments, veltuzumab is administered at a dose and dosing interval described herein for a period of time, e.g., at least 2 weeks, e.g., at least 2, 3, 4, 5, 6, 7, 8, 9, 10, 11, 12, 13, 14, 15, 16, 17, 18, 19, 20, 22, 24, 26, 28, 30, 40, 50, 60 weeks or greater, or 1, 2, 3, 4, 5, 6, 7, 8, 9, 10, 11, 12 months or greater, or 1, 2, 3, 4, 5 years or greater. For example, veltuzumab is administered at a dose and dosing interval described herein for a total of at least 4 doses per treatment cycle (e.g., at least 4, 5, 6, 7, 8, 9, 10, 11, 12, 13, 14, 15, 16, 18, 20, or more doses per treatment cycle).

In some aspects, the anti-CD20 antibody comprises GA101. GA101 (also called obinutuzumab or RO5072759) is a humanized and glyco-engineered anti-CD20 monoclonal antibody. For example, GA101 can be used to treat diseases such as B-cell lymphoid malignancies, e.g., CLL, non-Hodgkin lymphoma (NHL) and diffuse large B-cell lymphoma (DLBCL). See, e.g., Robak. Curr. Opin. Investig. Drugs. 10.6(2009):588-96; Clinical Trial Identifier Numbers: NCT01995669, NCT01889797, NCT02229422, and NCT01414205; and www.accessdata.fda.gov/drugsatfda_docs/label/2013/125486s000lbl.pdf.

In some embodiments, GA101 is administered intravenously, e.g., as an intravenous infusion. For example, each infusion provides about 100-3000 mg (e.g., about 100-150, 150-200, 200-250, 250-500, 300-350, 350-400, 400-450, 450-500, 500-550, 550-600, 600-650, 650-700, 700-750, 750-800, 800-850, 850-900, 900-950, 950-1000, 1000-1200, 1200-1400, 1400-1600, 1600-1800, 1800-2000, 2000-2200, 2200-2400, 2400-2600, 2600-2800, or 2800-3000 mg) of GA101.

In some embodiments, GA101 is administered at a dosing interval of at least 7 days, e.g., 7, 14, 21, 28, 35 days, or more. For example, GA101 is administered at a dosing interval of at least 1 week, e.g., 1, 2, 3, 4, 5, 6, 7, 8, 9, 10, 11, 12, 24, 26, 28, 20, 22, 24, 26, 28, 30 weeks, or more. For example, GA101 is administered at a dosing interval of at least 1 month, e.g., 1, 2, 3, 4, 5, 6, 7, 8, 9, 10, 11, 12, or more months. In some embodiments, GA101 is administered at a dosing interval of 1, 2, 3, 4, 5, 6, 7, 8, 9, 10, 11, 12, 13, or 14 days.

In some embodiments, GA101 is administered at a dose and dosing interval described herein for a period of time, e.g., at least 1 week, e.g., 1, 2, 3, 4, 5, 6, 7, 8, 9, 10, 11, 12, 13, 14, 15, 16, 17, 18, 19, 20, 22, 24, 26, 28, 30, 40, 50, 60 weeks or greater, or 1, 2, 3, 4, 5, 6, 7, 8, 9, 10, 11, 12 months or greater, or 1, 2, 3, 4, 5 years or greater. For example, GA101 is administered at a dose and dosing interval described herein for a total of at least 2 doses per treatment cycle (e.g., at least 2, 3, 4, 5, 6, 7, 8, 9, 10, 11, 12, 13, 14, 15, 16, 18, 20, or more doses per treatment cycle).

In some aspects, the anti-CD20 antibody comprises AME-133v. AME-133v (also called LY2469298 or ocaratuzumab) is a humanized IgG1 monoclonal antibody against CD20 with increased affinity for the FcγRIIIa receptor and an enhanced antibody dependent cellular cytotoxicity (ADCC) activity compared with rituximab. See, e.g., Robak et al. BioDrugs 25.1(2011):13-25. In some embodiments, AME-133v can be used to treat cancers such as NHL, e.g., follicular lymphoma. See, e.g., Forero-Torres et al. Clin Cancer Res. 18.5(2012):1395-403.

In some aspects, the anti-CD20 antibody comprises PRO131921. PRO131921 is a humanized anti-CD20 monoclonal antibody engineered to have better binding to FcγRIIIa and enhanced ADCC compared with rituximab. See, e.g., Robak et al. BioDrugs 25.1(2011):13-25; and Casulo et al. Clin Immunol. 154.1(2014):37-46. In some embodiments, PRO131921 can be used to treat NHL. See, e.g., Clinical Trial Identifier No. NCT00452127. In some embodiments, PRO131921 is administered intravenously, e.g., as an intravenous infusion. In some embodiments, PRO131921 is administered at a dose of 15 mg/m$^2$ to 1000 mg/m$^2$, e.g., about 15-20, 20-25, 25-30, 30-35, 35-40, 40-45, 45-50, 50-55, 55-60, 60-65, 65-70, 70-75, 75-80, 80-85, 85-90, 90-95, 95-100, 100-125, 125-150, 150-175, 175-200, 200-226, 225-250, 250-300, 300-325, 325-350, 350-375, 375-400, 400-425, 425-450, 450-475, 475-500, 500-525, 525-550, 550-575, 575-600, 600-625, 625-650, 650-675, 675-700, 700-725, 725-750, 750-775, 775-800, 800-825, 825-850, 850-875, 875-900, 900-925, 925-950, 950-975, or 975-1000 mg/m$^2$, where m$^2$ indicates the body surface area of the subject.

In some aspects, the anti-CD20 antibody comprises TRU-015. TRU-015 is an anti-CD20 fusion protein derived from domains of an antibody against CD20. TRU-015 is smaller than monoclonal antibodies, but retains Fc-mediated effector functions. See, e.g., Robak et al. BioDrugs 25.1(2011):13-25. TRU-015 contains an anti-CD20 single-chain variable fragment (scFv) linked to human IgG1 hinge, CH2, and CH3 domains but lacks CH1 and CL domains. In some embodiments, TRU-015 can be used to treat B-cell lymphomas and rheumatoid arthritis. In some cases, TRU-015 is administered intravenously, e.g., as an intravenous infusion. In some embodiments, TRU-015 is administered at a dose of 0.01-30 mg/kg, e.g., 0.01-0.015, 0.015-0.05, 0.05-0.15, 0.15-0.5, 0.5-1, 1-1.5, 1.5-2.5, 2.5-5, 5-10, 10-15, 15-20, 20-25, or 25-30 mg/kg body weight. In some embodiments, TRU-015 is administered at a dosing interval of at least 1 day, e.g., 1, 2, 3, 4, 5, 6, 7, 8, 9, 10, 11, 12, 13, or 14 days apart. See, e.g., Burge et al. Clin Ther. 30.10(2008):1806-16.

In some embodiments, an anti-CD20 antibody described herein is conjugated or otherwise bound to a therapeutic agent, e.g., a chemotherapeutic agent (e.g., cytoxan, fludarabine, histone deacetylase inhibitor, demethylating agent, peptide vaccine, anti-tumor antibiotic, tyrosine kinase inhibitor, alkylating agent, anti-microtubule or anti-mitotic agent, CD20 antibody, or CD20 antibody drug conjugate described herein), anti-allergic agent, anti-nausea agent (or anti-emetic), pain reliever, or cytoprotective agent described herein.

CD22 Inhibitors and Binding Domains

As used herein, the term "CD22," refers to an antigenic determinant known to be detectable on leukemia precursor cells. The human and murine amino acid and nucleic acid sequences can be found in a public database, such as GenBank, UniProt and Swiss-Prot. For example, the amino acid sequences of isoforms 1-5 human CD22 can be found at Accession Nos. NP 001762.2, NP 001172028.1, NP 001172029.1, NP 001172030.1, and NP 001265346.1, respectively, and the nucleotide sequence encoding variants 1-5 of the human CD22 can be found at Accession No. NM 001771.3, NM 001185099.1, NM 001185100.1, NM 001185101.1, and NM 001278417.1, respectively. As used herein, "CD22" includes proteins comprising mutations, e.g., point mutations, fragments, insertions, deletions and splice variants of full length wild-type CD22. In one aspect the antigen-binding portion of the CAR recognizes and binds an antigen within the extracellular domain of the CD22 protein. In one aspect, the CD22 protein is expressed on a cancer cell.

In some aspects, the present disclosure provides a CD22 inhibitor or binding domain, e.g., a CD22 inhibitor or binding domain as described herein. The disclosure also provides a nucleic acid encoding the CD22 binding domain, or a CAR comprising the CD22 binding domain. A CD22 inhibitor includes but is not limited to a CD22 CAR-expressing cell, e.g., a CD22 CART cell or an anti-CD22 antibody (e.g., an anti-CD22 mono- or bispecific antibody) or a fragment thereof. The composition may also comprise a second agent, e.g., an anti-CD19 CAR-expressing cell or a CD19 binding domain. The agents may be, e.g., encoded by a single nucleic acid or different nucleic acids.

In some aspects, a CD22 inhibitor or binding domain is administered as a monotherapy. In some aspects, the CD22 inhibitor or binding domain is administered in combination with a second agent such as an anti-CD19 CAR-expressing cell. In an embodiment, the CD22 inhibitor is administered in combination with a CD19 inhibitor, e.g., a CD19 CAR-expressing cell, e.g., a CAR-expressing cell described herein e.g., a cell expressing a CAR comprising an antibody binding domain that is murine, human, or humanized.

CD22 CAR-Expressing Cells, e.g., CARTs

In one embodiment, the CD22 inhibitor is a CD22 CAR-expressing cell, e.g., a CD22-CAR that comprises a CD22 binding domain and is engineered into a cell (e.g., T cell or NK cell) for administration in combination with CD19 CAR-expressing cell, e.g., CART, and methods of their use for adoptive therapy.

In another aspect, the present invention provides a population of CAR-expressing cells, e.g., CART cells, comprising a mixture of cells expressing CD19 CARs and CD22 CARs. For example, in one embodiment, the population of CART cells can include a first cell expressing a CD19 CAR and a second cell expressing a CD22 CAR. In one embodiment, the population of CAR-expressing cells includes, e.g., a first cell expressing a CAR (e.g., a CD19 CAR or CD22 CAR) that includes a primary intracellular signaling domain, and a second cell expressing a CAR (e.g., a CD19 CAR or CD22 CAR) that includes a secondary signaling domain.

In one aspect, the CD22-CAR comprises an optional leader sequence (e.g., an optional leader sequence described herein), an extracellular antigen binding domain, a hinge (e.g., hinge described herein), a transmembrane domain (e.g., transmembrane domain described herein), and an intracellular stimulatory domain (e.g., intracellular stimulatory domain described herein). In one aspect an exemplary CD22 CAR construct comprises an optional leader sequence (e.g., a leader sequence described herein), an extracellular antigen binding domain, a hinge, a transmembrane domain, an intracellular costimulatory domain (e.g., an intracellular costimulatory domain described herein) and an intracellular stimulatory domain.

In one aspect, the CAR22 binding domain comprises the scFv portion of an amino acid sequence (or encoded by a nucleotide sequence) provided in any of SEQ ID NOs: 200-428. In one aspect, the CAR22 binding domain comprises the scFv portion provided in any of SEQ ID NOs: 203, 209, 215, 221, 227, 232, 238, 244, 250, 256, 262, 268, 274, 280, 286, 292, 298, 304, 310, 316, 322, 328, 334, 340, 346, 352, 358, 364, 370, 376, 382, 388, 394, 400, 406, 412, 418, or 423.

In specific aspects, a CAR construct of the invention comprises a scFv domain selected from the group consisting of SEQ ID NOS: 203, 209, 215, 221, 227, 232, 238, 244, 250, 256, 262, 268, 274, 280, 286, 292, 298, 304, 310, 316, 322, 328, 334, 340, 346, 352, 358, 364, 370, 376, 382, 388, 394, 400, 406, 412, 418, or 423, wherein the scFv may be preceded by an optional leader sequence such as provided in SEQ ID NO: 13, and followed by an optional hinge sequence such as provided in SEQ ID NO:14 or SEQ ID NO:45 or SEQ ID NO:47 or SEQ ID NO:49, a transmembrane region such as provided in SEQ ID NO:15, an intracellular signalling domain that includes SEQ ID NO:16 or SEQ ID NO:51 and a CD3 zeta sequence that includes SEQ ID NO:17 or SEQ ID NO:43, e.g., wherein the domains are contiguous with and in the same reading frame to form a single fusion protein. In some embodiments, the scFv domain is a human scFv domain selected from the group consisting of SEQ ID NOS: 203, 209, 215, 221, 227, 232, 238, 244, 250, 256, 262, 268, 274, 280, 286, 292, 298, 304, 310, 316, 322, 328, 334, 340, 346, 352, 358, 364, 370, 376, 382, 388, 394, 400, 406, 412, 418, or 423.

Also included in the invention is a nucleotide sequence that encodes the polypeptide of each of the scFv fragments selected from the group consisting of SEQ ID NO: 203, 209, 215, 221, 227, 232, 238, 244, 250, 256, 262, 268, 274, 280, 286, 292, 298, 304, 310, 316, 322, 328, 334, 340, 346, 352, 358, 364, 370, 376, 382, 388, 394, 400, 406, 412, 418, or 423. Also included in the invention is a nucleotide sequence that encodes the polypeptide of each of the scFv fragments selected from the group consisting of SEQ ID NO: 203, 209, 215, 221, 227, 232, 238, 244, 250, 256, 262, 268, 274, 280, 286, 292, 298, 304, 310, 316, 322, 328, 334, 340, 346, 352, 358, 364, 370, 376, 382, 388, 394, 400, 406, 412, 418, or 423, and each of the domains of SEQ ID NOS: 13-17, plus the encoded CD22 CAR of the invention.

In some embodiments, full-length CD22 CAR sequences are also provided herein as SEQ ID NOS: 207, 213, 219, 225, 230, 236, 242, 248, 254, 260, 266, 272, 278, 284, 290, 296, 302, 308, 314, 320, 326, 332, 338, 344, 350, 356, 362, 368, 374, 380, 386, 392, 398, 404, 410, 416, 422, or 427, as shown in Table 6A or 6B.

In one aspect, the present invention encompasses a recombinant nucleic acid construct comprising a nucleic acid molecule encoding a CAR, wherein the nucleic acid molecule comprises the nucleic acid sequence encoding a CD22 binding domain, e.g., described herein, e.g., that is contiguous with and in the same reading frame as a nucleic acid sequence encoding an intracellular signaling domain. In one aspect, a CD22 binding domain is selected from one or more of SEQ ID NOS: 203, 209, 215, 221, 227, 232, 238, 244, 250, 256, 262, 268, 274, 280, 286, 292, 298, 304, 310, 316, 322, 328, 334, 340, 346, 352, 358, 364, 370, 376, 382, 388, 394, 400, 406, 412, 418, or 423. In one aspect, the present invention encompasses a recombinant nucleic acid construct comprising a nucleic acid molecule encoding a CAR, wherein the nucleic acid molecule comprises a nucleic acid sequence encoding a CD22 binding domain, e.g., wherein the sequence is contiguous with and in the same reading frame as the nucleic acid sequence encoding an intracellular signaling domain. An exemplary intracellular signaling domain that can be used in the CAR includes, but is not limited to, one or more intracellular signaling domains of, e.g., CD3-zeta, CD28, 4-1BB, and the like. In some instances, the CAR can comprise any combination of CD3-zeta, CD28, 4-1BB, and the like.

In one aspect, the nucleic acid sequence of a CAR construct of the invention comprises the CAR construct of one or more of SEQ ID NOS: 200, 208, 214, 220, 226, 231, 237, 243, 249, 255, 261, 267, 273, 279, 285, 291, 297, 303, 309, 315, 321, 327, 333, 339, 345, 351, 357, 363, 369, 375, 381, 387, 393, 399, 405, 411, 417, 422, or 428. In one aspect, the nucleic acid sequence of a CAR construct of the invention comprises an scFv-encoding sequence of one or more of SEQ ID NOs: 204, 210, 216, 222, 116, 233, 239, 245, 251, 257, 263, 269, 275, 281, 287, 293, 299, 305, 311, 317, 323, 329, 335, 341, 347, 353, 359, 365, 371, 377, 383, 389, 395, 401, 407, 413, 117, or 424.

In some instances, it is beneficial for the antigen binding domain to be derived from the same species in which the CAR will ultimately be used in. For example, for use in humans, it may be beneficial for the antigen binding domain of the CAR to comprise human or humanized residues for the antigen binding domain of an antibody or antibody fragment. Thus, in one aspect, the antigen binding domain comprises a human antibody or an antibody fragment. In one embodiment, the human CD22 binding domain comprises one or more (e.g., all three) light chain complementary determining region 1 (LC CDR1), light chain complementary determining region 2 (LC CDR2), and light chain complementary determining region 3 (LC CDR3) of a human CD22 binding domain described herein, and/or one or more (e.g., all three) heavy chain complementary determining region 1 (HC CDR1), heavy chain complementary determining region 2 (HC CDR2), and heavy chain complementary determining region 3 (HC CDR3) of a human CD22 binding domain described herein, e.g., a human CD22 binding domain comprising one or more, e.g., all three, LC CDRs and one or more, e.g., all three, HC CDRs. In one embodiment, the human CD22 binding domain comprises one or more (e.g., all three) heavy chain complementary determining region 1 (HC CDR1), heavy chain complementary determining region 2 (HC CDR2), and heavy chain complementary determining region 3 (HC CDR3) of a human CD22 binding domain described herein, e.g., the human CD22 binding domain has two variable heavy chain regions, each comprising a HC CDR1, a HC CDR2 and a HC CDR3 described herein. In one embodiment, the human CD22 binding domain comprises a human light chain variable region described herein (e.g., in Table 6A, 6B, 10A or 10B) and/or a human heavy chain variable region described herein (e.g., in Table 6A, 6B, 9A or 9B). In one embodiment, the human CD22 binding domain comprises a human heavy chain variable region described herein (e.g., in Table 6A, 6B, 9A or 9B), e.g., at least two human heavy chain variable regions described herein (e.g., in Table 6A, 8B, 9A or 9B). In one embodiment, the CD22 binding domain is a scFv comprising a light chain and a heavy chain of an amino acid sequence of Table 6A, 6B, 9A, 9B, 10A, or 10B. In an embodiment, the CD22 binding domain (e.g., an scFv) comprises: a light chain variable region comprising an amino acid sequence having at least one, two or three modifications (e.g., substitutions) but not more than 30, 20 or 10 modifications (e.g., substitutions) of an amino acid sequence of a light chain variable region provided in Table 6A, 6B, 10A, or 10B, or a sequence with 95-99% identity with an amino acid sequence of Table 6A, 6B, 10A, or 10B; and/or a heavy chain variable region comprising an amino acid sequence having at least one, two or three modifications (e.g., substitutions) but not more than 30, 20 or 10 modifications (e.g., substitutions) of an amino acid sequence of a heavy chain variable region provided in Table 6A, 6B, 9A, or 9B, or a sequence with 95-99% identity to an amino acid sequence of Table 6A, 6B, 9A or 9B. In one embodiment, the human CD22 binding domain comprises a sequence selected from a group consisting of SEQ ID NO: 203, 209, 215, 221, 227, 232, 238, 244, 250, 256, 262, 268, 274, 280, 286, 292, 298, 304, 310, 316, 322, 328, 334, 340, 346, 352, 358, 364, 370, 376, 382, 388, 394, 400, 406, 412, 418, or 423, or a sequence with 95-99% identity thereof. In one embodiment, the human CD22 binding domain is a scFv, and a light chain variable region comprising an amino acid sequence described herein, e.g., in Table 6A, 6B, 10A, or 10B, is attached to a heavy chain variable region comprising an amino acid sequence described herein, e.g., in Table 6A, 6B, 9A, or 9B, via a linker, e.g., a linker described herein. In one embodiment, the human CD22 binding domain includes a (Gly$_4$-Ser)n linker, wherein n is 1, 2, 3, 4, 5, or 6, e.g., 3 or 4 (SEQ ID NO:53). The light chain variable region and heavy chain variable region of a scFv can be, e.g., in any of the following orientations: light chain variable region-linker-heavy chain variable region or heavy chain variable region-linker-light chain variable region.

In one aspect, the CD22 binding domain is characterized by particular functional features or properties of an antibody or antibody fragment. For example, in one aspect, the portion of a CAR composition of the invention that comprises an antigen binding domain specifically binds human CD22 or a fragment thereof. In one aspect, the invention relates to an antigen binding domain comprising an antibody or antibody fragment, wherein the antibody binding domain specifically binds to a CD22 protein or fragment thereof, wherein the antibody or antibody fragment comprises a variable heavy chain that includes an amino acid sequence of any of SEQ ID NO:s 700, 701, 702, 703, 704, 705, 706, 707, 708, 709, 710, 711, 712, 713, 714, 715, 716, 717, 718, 719, 720, 721, 722, 723, 724, 725, 726, 727, 728, 729, 730, 731, 732, 733, 734, 735, 736, 737, or 738, and/or a variable light chain that includes an amino acid sequence of any of SEQ ID NOs 739, 740, 741, 742, 743, 744, 745, 746, 747, 748, 749, 750, 751, 752, 753, 754, 755, 756, 757, 758, 759, 760, 761, 762, 763, 764, 765, 766, 767, 768, 769, 770, 771, 772, 773, 774, 775, 776, or 777. In certain aspects, the scFv is contiguous with and in the same reading frame as a leader sequence. In one aspect the leader sequence is the polypeptide sequence provided as SEQ ID NO:13.

In embodiments, the CAR comprises an antibody or antibody fragment which includes a CD22 binding domain, a transmembrane domain, and an intracellular signaling domain. In embodiments, the CD22 binding domain comprises one or more of light chain complementary determining region 1 (LC CDR1), light chain complementary determining region 2 (LC CDR2), and light chain complementary determining region 3 (LC CDR3) of any CD22 light chain binding domain amino acid sequence listed in Table 8A, 8B, 10A or 10B, and one or more of heavy chain complementary determining region 1 (HC CDR1), heavy chain complementary determining region 2 (HC CDR2), and heavy chain complementary determining region 3 (HC CDR3) of any CD22 heavy chain binding domain amino acid sequence listed in Table 7A, 7B, 7C, 9A, or 9B.

In one aspect, the CD22 binding domain is a fragment, e.g., a single chain variable fragment (scFv). In one aspect, the CD22 binding domain is a Fv, a Fab, a (Fab')2, or a bi-functional (e.g. bi-specific) hybrid antibody (e.g., Lanzavecchia et al., Eur. J. Immunol. 17, 105 (1987)). In one aspect, the antibodies and fragments thereof of the invention binds a CD22 protein or a fragment thereof with wild-type or enhanced affinity.

In some instances, a human scFv can be derived from a display library.

In one embodiment, the CD22 binding domain, e.g., scFv comprises at least one mutation such that the mutated scFv confers improved stability to the CART22 construct. In another embodiment, the CD22 binding domain, e.g., scFv comprises at least 1, 2, 3, 4, 5, 6, 7, 8, 9, 10 mutations arising, e.g., from the humanization process such that the mutated scFv confers improved stability to the CART22 construct.

In one aspect, the present invention contemplates modifications of the starting antibody or fragment (e.g., scFv) amino acid sequence that generate functionally equivalent molecules. For example, the VH or VL of a CD22 binding domain, e.g., scFv, comprised in the CAR can be modified to retain at least about 70%, 71%. 72%. 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% identity of the starting VH or VL framework region of the CD22 binding domain, e.g., scFv. The present invention contemplates modifications of the entire CAR construct, e.g., modifications in one or more amino acid sequences of the various domains of the CAR construct in order to generate functionally equivalent molecules. The CAR construct can be modified to retain at least about 70%, 71%. 72%. 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% identity of the starting CAR construct.

In an embodiment, the CD22 binding domain comprises six CDRs (e.g., one each of a HC CDR1, HC CDR2, HC CDR3, LC CDR1, LC CDR2, and LC CDR3) of any one of CAR22-1, CAR22-2, CAR22-3, CAR22-4, CAR22-5, CAR22-6, CAR22-7, CAR22-8, CAR22-9, CAR22-10, CAR22-11, CAR22-12, CAR22-13, CAR22-14, CAR22-15, or CAR22-16, CAR22-17, CAR22-18, CAR22-19, CAR22-20, CAR22-21, CAR22-22, CAR22-23, CAR22-24, CAR22-25, CAR22-26, CAR22-27, CAR22-28, CAR22-29, CAR22-30, CAR22-31, CAR22-32, CAR22-33, CAR22-34, CAR22-35, CAR22-36, CAR22-37, or CAR22-38 (e.g., as described in Table 7A, 7B, 7C, 8A and/or 8B), or a sequence substantially identical thereto. In an embodiment, the CD22 binding domain comprises three CDRs (e.g., one each of a HC CDR1, HC CDR2, and HC CDR3, or one each of a LC CDR1, LC CDR2, and LC CDR3) of any one of CAR22-1, CAR22-2, CAR22-3, CAR22-4, CAR22-5, CAR22-6, CAR22-7, CAR22-8, CAR22-9, CAR22-10, CAR22-11, CAR22-12, CAR22-13, CAR22-14, CAR22-15, or CAR22-16, CAR22-17, CAR22-18, CAR22-19, CAR22-20, CAR22-21, CAR22-22, CAR22-23, CAR22-24, CAR22-25, CAR22-26, CAR22-27, CAR22-28, CAR22-29, CAR22-30, CAR22-31, CAR22-32, CAR22-33, CAR22-34, CAR22-35, CAR22-36, CAR22-37, or CAR22-38 (e.g., as described in Table 7A, 7B, 7C, 8A and/or 8B), or a sequence substantially identical thereto.

Further embodiments include a nucleotide sequence that encodes a polypeptide described in this section. For example, further embodiments include a nucleotide sequence that encodes a polypeptide of any of Tables 6A-10B. For instance, the nucleotide sequence can comprise a CAR construct or scFv of Table 6A or 6B. The nucleotide may encode a VH of Table 9A or 9B, a VL or Table 10A or 10B, or both. The nucleotide may encode one or more of (e.g., two or three of) a VH CDR1, VH CDR2, or VH CDR3 of Table 7A, 7B, or 7C and/or the nucleotide may encode one or more of (e.g., two or three of) a VL CDR1, VL CDR2, or VL CDR3 of Table 8A or 8B. The nucleotide sequence can also include one or more of, e.g., all of the domains of SEQ ID NOS: 13, 14, 15, 16, 17, and 51.

The CD22 CAR may also comprise one or more of a a transmembrane domain, e.g., a transmembrane domain as described herein, an intracellular signaling domain, e.g., intracellular signaling domain as described herein, a costimulatory domain, e.g., a costimulatory domain as described herein, a leader sequence, e.g. a leader sequence as described herein, or a hinge, e.g., a hinge as described herein.

In one embodiment, the CD22 inhibitor is a CD22 inhibitor described herein. The CD22 inhibitor can be, e.g., an anti-CD22 antibody (e.g., an anti-CD22 mono- or bispecific antibody), a small molecule, or a CD22 CART. In some embodiments the anti-CD22 antibody is conjugated or otherwise bound to a therapeutic agent. Exemplary therapeutic agents include, e.g., microtubule disrupting agents (e.g., monomethyl auristatin E) and toxins (e.g., diphtheria toxin or *Pseudomonas* exotoxin-A, ricin). In an embodiment, the CD22 inhibitor is administered in combination with a CD19 inhibitor, e.g., a CD19 CAR-expressing cell, e.g., a CAR-expressing cell described herein e.g., a cell expressing a CAR comprising an antibody binding domain that is murine, human, or humanized.

In one embodiment, the anti-CD22 antibody is selected from an anti-CD19/CD22 bispecific ligand-directed toxin (e.g., two scFv ligands, recognizing human CD19 and CD22, linked to the first 389 amino acids of diphtheria toxin (DT), DT 390, e.g., DT2219ARL); anti-CD22 monoclonal antibody-MMAE conjugate (e.g., DCDT2980S); scFv of an anti-CD22 antibody RFB4 fused to a fragment of *Pseudomonas* exotoxin-A (e.g., BL22); deglycosylated ricin A chain-conjugated anti-CD19/anti-CD22 (e.g., Combotox); humanized anti-CD22 monoclonal antibody (e.g., epratuzumab); or the Fv portion of an anti-CD22 antibody covalently fused to a 38 KDa fragment of *Pseudomonas* exotoxin-A (e.g., moxetumomab pasudotox).

In one embodiment, the anti-CD22 antibody is an anti-CD19/CD22 bispecific ligand-directed toxin (e.g., DT2219ARL) and the anti-CD19/CD22 bispecific ligand-directed toxin is administered at a dose of about 1 µg/kg, 2 µg/kg, 3 µg/kg, 4 µg/kg, 5 µg/kg, 6 µg/kg, 7 µg/kg, 8 µg/kg, 9 µg/kg, 10 µg/kg, 11 µg/kg, 12 µg/kg, 13 µg/kg, 14 µg/kg, 15 µg/kg, 20 µg/kg, 25 µg/kg, 30 µg/kg, 40 µg/kg, 60 µg/kg, 80 µg/kg, 100 µg/kg, 120 µg/kg, 140 µg/kg, 160 µg/kg, 180 µg/kg, 200 µg/kg, 220 µg/kg, 250 µg/kg, 300 µg/kg, 350 µg/kg, 400 µg/kg, 450 µg/kg, 500 µg/kg, 600 µg/kg, 700 µg/kg, 800 µg/kg, 900 µg/kg, 1 mg·kg (e.g., 30 µg/kg, 40 µg/kg, 60 µg/kg, or 80 µg/kg) for a period of time, e.g., every 1, 2, 3, 4, 5, 6, 7, 8, 9, 10, 11, 12 or more days. In some embodiments, the anti-CD19/CD22 bispecific ligand-directed toxin is administered via intravenous infusion.

In one embodiment, the anti-CD22 antibody is BL22 and BL22 is administered at a dose of about 1 µg/kg, 2 µg/kg, 3 µg/kg, 4 µg/kg, 5 µg/kg, 6 µg/kg, 7 µg/kg, 8 µg/kg, 9 µg/kg, 10 µg/kg, 11 µg/kg, 12 µg/kg, 13 µg/kg, 14 µg/kg, 15 µg/kg, 20 µg/kg, 25 µg/kg, 30 µg/kg, 40 µg/kg, 60 µg/kg, 80 µg/kg, 100 µg/kg, 120 µg/kg, 140 µg/kg, 160 µg/kg, 180 µg/kg, 200 µg/kg, 220 µg/kg, 250 µg/kg, 300 µg/kg, 350 µg/kg, 400 µg/kg, 450 µg/kg, 500 µg/kg, 600 µg/kg, 700 µg/kg, 800 µg/kg, 900 µg/kg, 1 mg·kg (e.g., 3 µg/kg, 30 µg/kg, 40 µg/kg, or 50 µg/kg) for a period of time, e.g., every 1, 2, 3, 4, 5, 6, 7, 8, 9, 10, 11, 12 or more days. In some embodiments, BL22 is administered daily, every other day, every third, day, or every fourth day for a period of time, e.g., for a 4 day cycle, a 6 day cycle, an 8 day cycle, a 10 day cycle, a 12 day cycle, or a 14 day cycle. In one embodiment, 1, 2, 3, 4, 5, 6, 7, 8, 9, 10, 11, 12 or more cycles of BL22 are administered. In some embodiments, BL22 is administered via intravenous infusion.

In one embodiment, the anti-CD22 antibody is a deglycosylated ricin A chain-conjugated anti-CD19/anti-CD22 (e.g., Combotox) and the deglycosylated ricin A chain-conjugated anti-CD19/anti-CD22 is administered at a dose of about 500 µg/m$^2$, 600 µg/m$^2$, 700 µg/m$^2$, 800 µg/m$^2$, 900 µg/m$^2$, 1 mg/m$^2$, 2 mg/m$^2$, 3 mg/m$^2$, 4 mg/m$^2$, 5 mg/m$^2$, 6 mg/m$^2$, or 7 mg/m$^2$ for a period of time, e.g., every 1, 2, 3, 4, 5, 6, 7, 8, 9, 10, 11, or 12 or more days. In some embodiments, the deglycosylated ricin A chain-conjugated anti-CD19/anti-CD22 is administered daily, every other day, every third, day, or every fourth day for a period of time, e.g., for a 4 day cycle, a 6 day cycle, an 8 day cycle, a 10 day cycle, a 12 day cycle, or a 14 day cycle (e.g., every other day for 6 days). In one embodiment, 1, 2, 3, 4, 5, 6, 7, 8, 9, 10, 11, 12 or more cycles of the deglycosylated ricin A chain-conjugated anti-CD19/anti-CD22 are administered. In some embodiments, the deglycosylated ricin A chain-conjugated anti-CD19/anti-CD22 is administered via intravenous infusion.

In one embodiment, the anti-CD22 antibody is a humanized anti-CD22 monoclonal antibody (e.g., epratuzumab) and the humanized anti-CD22 monoclonal antibody is administered at a dose of about 10 mg/m²/week, 20 mg/m²/week, 50 mg/m²/week, 100 mg/m²/week, 120 mg/m²/week, 140 mg/m²/week, 160 mg/m²/week, 180 mg/m²/week, 200 mg/m²/week, 220 mg/m²/week, 250 mg/m²/week, 260 mg/m²/week, 270 mg/m²/week, 280 mg/m²/week, 290 mg/m²/week, 300 mg/m²/week, 305 mg/m²/week, 310 mg/m²/week, 320 mg/m²/week, 325 mg/m²/week, 330 mg/m²/week, 335 mg/m²/week, 340 mg/m²/week, 345 mg/m²/week, 350 mg/m²/week, 355 mg/m²/week, 360 mg/m²/week, 365 mg/m²/week, 370 mg/m²/week, 375 mg/m²/week, 380 mg/m²/week, 385 mg/m²/week, 390 mg/m²/week, 400 mg/m²/week, 410 mg/m²/week, 420 mg/m²/week, 430 mg/m²/week, 440 mg/m²/week, 450 mg/m²/week, 460 mg/m²/week, 470 mg/m²/week, 480 mg/m²/week, 490 mg/m²/week, 500 mg/m²/week, 600 mg/m²/week, 700 mg/m²/week, 800 mg/m²/week, 900 mg/m²/week, 1 g/m²/week, or 2 g/m²/week (e.g., 360 mg/m²/week or 480 mg/m²/week) for a period of time, e.g., every 1, 2, 3, 4, 5, 6, 7, 8, 9, 10, 11, 12 or more weeks. In some embodiments a first dose is lower than subsequent doses (e.g. a first dose of 360 mg/m²/week followed by subsequent doses of 370 mg/m²/week). In some embodiments, the humanized anti-CD22 monoclonal antibody is administered via intravenous infusion.

In one embodiment, the anti-CD22 antibody is moxetumomab pasudotox and moxetumomab pasudotox is administered at a dose of about 1 µg/kg, 2 µg/kg, 3 µg/kg, 4 µg/kg, 5 µg/kg, 6 µg/kg, 7 µg/kg, 8 µg/kg, 9 µg/kg, 10 µg/kg, 11 µg/kg, 12 µg/kg, 13 µg/kg, 14 µg/kg, 15 µg/kg, 20 µg/kg, 30 µg/kg, 40 µg/kg, 60 µg/kg, 80 µg/kg, 100 µg/kg, 120 µg/kg, 140 µg/kg, 160 µg/kg, 180 µg/kg, 200 µg/kg, 220 µg/kg, 250 µg/kg, 300 µg/kg, 350 µg/kg, 400 µg/kg, 450 µg/kg, 500 µg/kg (e.g., 5 µg/kg, 10 µg/kg, 20 µg/kg, 30 µg/kg, 40 µg/kg, or 50 µg/kg) a period of time, e.g., every 1, 2, 3, 4, 5, 6, 7, 8, 9, 10, 11, 12 or more days. In some embodiments, the moxetumomab pasudotox is administered daily, every other day, every third, day, or every fourth day for a period of time, e.g., for a 4 day cycle, a 6 day cycle, an 8 day cycle, a 10 day cycle, a 12 day cycle, or a 14 day cycle (e.g., every other day for 6 days). In one embodiment, 1, 2, 3, 4, 5, 6, 7, 8, 9, 10, 11, 12 or more cycles of the moxetumomab pasudotox are administered. In some embodiments, the moxetumomab pasudotox is administered via intravenous infusion.

In an embodiment, a CD22 antibody molecule comprises six CDRs (e.g., one each of a HC CDR1, HC CDR2, HC CDR3, LC CDR1, LC CDR2, and LC CDR3) of any one of CAR22-1, CAR22-2, CAR22-3, CAR22-4, CAR22-5, CAR22-6, CAR22-7, CAR22-8, CAR22-9, CAR22-10, CAR22-11, CAR22-12, CAR22-13, CAR22-14, CAR22-15, or CAR22-16, CAR22-17, CAR22-18, CAR22-19, CAR22-20, CAR22-21, CAR22-22, CAR22-23, CAR22-24, CAR22-25, CAR22-26, CAR22-27, CAR22-28, CAR22-29, CAR22-30, CAR22-31, CAR22-32, CAR22-33, CAR22-34, CAR22-35, CAR22-36, CAR22-37, or CAR22-38 (e.g., as described in Table 7A, 7B, 7C, 8A and/or 8B), or a sequence substantially identical thereto. In an embodiment, a CD22 antibody molecule comprises three CDRs (e.g., one each of a HC CDR1, HC CDR2, and HC CDR3, or one each of a LC CDR1, LC CDR2, and LC CDR3) of any one of CAR22-1, CAR22-2, CAR22-3, CAR22-4, CAR22-5, CAR22-6, CAR22-7, CAR22-8, CAR22-9, CAR22-10, CAR22-11, CAR22-12, CAR22-13, CAR22-14, CAR22-15, or CAR22-16, CAR22-17, CAR22-18, CAR22-19, CAR22-20, CAR22-21, CAR22-22, CAR22-23, CAR22-24, CAR22-25, CAR22-26, CAR22-27, CAR22-28, CAR22-29, CAR22-30, CAR22-31, CAR22-32, CAR22-33, CAR22-34, CAR22-35, CAR22-36, CAR22-37, or CAR22-38 (e.g., as described in Table 7A, 7B, 7C, 8A, and/or 8B), or a sequence substantially identical thereto. In an embodiment, a CD22 antibody molecule comprises a heavy chain variable region, a light chain variable region, or both of a heavy chain variable region and light chain variable region, or an scFv, as described in Table 6A or 6B, or a sequence substantially identical thereto. In embodiments, the CD22 antibody molecule is an isolated antibody molecule.

ROR1 Inhibitors

As used herein, the term "ROR1" refers to an antigenic determinant known to be detectable on leukemia precursor cells. The human and murine amino acid and nucleic acid sequences can be found in a public database, such as GenBank, UniProt and Swiss-Prot. For example, the amino acid sequences of isoforms 1 and 2 precursors of human ROR1 can be found at Accession Nos. NP_005003.2 and NP_001077061.1, respectively, and the mRNA sequences encoding them can be found at Accession Nos. NM_005012.3 and NM_001083592.1, respectively. As used herein, "ROR1" includes proteins comprising mutations, e.g., point mutations, fragments, insertions, deletions and splice variants of full length wild-type ROR1. In one aspect the antigen-binding portion of the CAR recognizes and binds an antigen within the extracellular domain of the ROR1 protein. In one aspect, the ROR1 protein is expressed on a cancer cell.

Also provided herein are ROR1 inhibitors and combination therapies. ROR1 inhibitors include but are not limited to anti-ROR1 CAR-expressing cells, e.g. CARTs, and anti-ROR antibodies (e.g., an anti-ROR1 mono- or bispecific antibody) and fragments thereof. In some embodiments, anti-ROR1 inhibitors can be used to treat B-cell malignancies (e.g., leukemias, such as CLL, and B-cell lymphomas, such as mantle cell lymphoma; ALL; small lymphocytic lymphoma; marginal cell B-Cell lymphoma; and Burkett's Lymphoma) or epithelial cancers (e.g., breast cancer, renal cell carcinoma, lung cancer, colorectal cancers, ovarian cancer, and melanoma). In an embodiment, the CD20 inhibitor is administered in combination with a CD19 inhibitor, e.g., a CD19 CAR-expressing cell, e.g., a CAR-expressing cell described herein, e.g., a cell expressing a CAR comprising an antibody binding domain that is murine, human, or humanized.

An exemplary anti-ROR1 inhibitor is described in Hudecek, et al. Clin. Cancer Res. 19.12(2013):3153-64, incorporated herein by reference. For example, an anti-ROR1 inhibitor includes the anti-ROR1 CARTs described in Hudecek et al. (for example, generated as described in Hudecek et al. at page 3155, first full paragraph, incorporated herein by reference). In other examples, an anti-ROR1 inhibitor includes an antibody or fragment thereof comprising the VH and/or VL sequences of the 2A2 and R12 anti-ROR1 monoclonal antibodies described in Hudecek et al. at paragraph bridging pages 3154-55; Baskar et al. MAbs 4(2012):349-61; and Yang et al. PLoS ONE 6(2011):e21018, incorporated herein by reference.

In other embodiments, a ROR1 inhibitor includes an antibody or fragment thereof (e.g., single chain variable fragment (scFv)) that targets ROR1, including those described in US 2013/0101607, e.g., SEQ ID NOs: 1 or 2 of US 2013/0101607, incorporated herein by reference. In some embodiments, anti-ROR1 antibody fragments (e.g., scFvs) are conjugated or fused to a biologically active molecule, e.g., to form a chimeric antigen receptor (CAR) that directs immune cells, e.g., T cells to respond to ROR1-expressing cells.

In some embodiments, an exemplary ROR1 inhibitor includes an anti-ROR1 monoclonal antibody called UC-961 (Cirmtuzumab). See, e.g., Clinical Trial Identifier No. NCT02222688. Cirmtuzumab can be used to treat cancers, such as chronic lymphocytic leukemia (CLL), ovarian cancer, and melanoma. See, e.g., Hojjat-Farsangi et al. PLoS One. 8(4): e61167; and NCT02222688.

In some embodiments, cirmtuzumab is administered intravenously, e.g., as an intravenous infusion. For example, each infusion provides about 700-7000 µg (e.g., 700-750, 750-800, 800-850, 850-900, 900-950, 950-1000, 1000-1500, 1500-2000, 2000-2500, 2500-3000, 3000-3500, 3500-4000, 4000-4500, 4500-5000, 5000-5500, 5500-6000, 6000-6500, or 6500-7000 µg) of cirmtuzumab. In other embodiments, cirmtuzumab is administered at a dose of 10-100 µg/kg body weight, e.g., 10-15, 15-20, 20-25, 25-30, 30-35, 35-40, 40-45, 45-50, 50-55, 55-60, 60-65, 65-70, 70-75, 75-80, 80-85, 85-90, 90-95, or 95-100 µg/kg body weight. In one embodiment, cirmtuzumab is administered at a starting dose of 15 µg/kg body weight.

In some embodiments, cirmtuzumab is administered at a dosing interval of at least 7 days, e.g., 7, 14, 21, 28, 35 days, or more. For example, cirmtuzumab is administered at a dosing interval of at least 1 week, e.g., 1, 2, 3, 4, 5, 6, 7, 8, 9, 10, 11, 12, 24, 26, 28, 20, 22, 24, 26, 28, 30 weeks, or more.

In some embodiments, cirmtuzumab is administered at a dose and dosing interval described herein for a period of time, e.g., at least 1 week, e.g., 1, 2, 3, 4, 5, 6, 7, 8, 9, 10, 11, 12, 13, 14, 15, 16, 17, 18, 19, 20, 22, 24, 26, 28, 30, 40, 50, 60 weeks or greater, or 1, 2, 3, 4, 5, 6, 7, 8, 9, 10, 11, 12 months or greater, or 1, 2, 3, 4, 5 years or greater. For example, cirmtuzumab is administered at a dose and dosing interval described herein for a total of at least 2 doses per treatment cycle (e.g., at least 2, 3, 4, 5, 6, 7, 8, 9, 10, 11, 12, 13, 14, 15, 16, 18, 20, or more doses per treatment cycle).

In some embodiments, the anti-ROR1 antibody is conjugated or otherwise bound to a therapeutic agent.

In some embodiments, a ROR1 inhibitor includes an anti-ROR1 CAR-expressing cell, e.g., CART, e.g., a cell expressing an anti-ROR1 CAR construct or encoded by a ROR1 binding CAR comprising a scFv, CDRs, or VH and VL chains. For example, an anti-ROR1 CAR-expressing cell, e.g., CART is a generated by engineering a ROR1-CAR (that comprises a ROR1 binding domain) into a cell (e.g., a T cell or NK cell), e.g., for administration in combination with a CAR-expressing cell described herein. Also provided herein are methods of use of the CAR-expressing cells described herein for adoptive therapy.

In another aspect, provided herein is a population of CAR-expressing cells, e.g., CART cells, comprising a mixture of cells expressing CD19 CARs and ROR1 CARs. For example, in one embodiment, the population of CART cells can include a first cell expressing a CD19 CAR and a second cell expressing a ROR1 CAR.

CD123 Inhibitors

CD123 is also called the alpha-chain of the interleukin-3 receptor (IL-3RA). The IL-3 receptor (IL-3R) is a heterodimer composed of alpha and beta chains. IL-3R is a membrane receptor. The IL-3Rα chain is a glycoprotein of 360 amino acid residues. Abnormalities of CD123 are frequently observed in some leukemic disorders. CD123 is overexpressed in multiple hematologic malignancies, e.g., acute myeloid and B-lymphoid leukemias, blastic plasmocytoid dendritic neoplasms (BPDCN) and hairy cell leukemia.

As used herein, the term "CD123" refers to an antigenic determinant known to be detectable on some malignant hematological cancer cells, e.g., leukemia cells. The human and murine amino acid and nucleic acid sequences can be found in a public database, such as GenBank, UniProt and Swiss-Prot. For example, the amino acid sequences of human CD123 can be found at Accession Nos. NP_002174.1 (isoform 1 precursor); NP_001254642.1 (isoform 2 precursor), and the mRNA sequences encoding them can be found at Accession Nos. NM_002183.3 (variant 1); NM_001267713.1 (variant 2). As used herein, "CD123" includes proteins comprising mutations, e.g., point mutations, fragments, insertions, deletions and splice variants of full length wild-type CD123. In one aspect the antigen-binding portion of the CAR recognizes and binds an antigen within the extracellular domain of the CD123 protein. In one aspect, the CD123 protein is expressed on a cancer cell.

Provided herein are CD123 inhibitors and combination therapies. CD123 inhibitors include but are not limited to small molecules, recombinant proteins, anti-CD123 CAR-expressing cells, e.g. CARTs, and anti-CD123 antibodies (e.g., an anti-CD123 mono- or bispecific antibody) and fragments thereof. In some embodiments, anti-CD123 inhibitors can be used to treat a B-cell malignancy described herein. In an embodiment, the CD123 inhibitor is administered in combination with a CD19 inhibitor, e.g., a CD19 CAR-expressing cell, e.g., a CAR-expressing cell described herein, e.g., a cell expressing a CAR comprising an antibody binding domain that is murine, human, or humanized.

In one embodiment, the CD123 inhibitor is a recombinant protein, e.g., comprising the natural ligand (or a fragment) of the CD123 receptor. For example, the recombinant protein is SL-401 (also called DT3881L3; University of Texas Southwestern Medical Center), which is a fusion protein comprising human IL-3 fused to a truncated diphtheria toxin. See, e.g., Testa et al. Biomark Res. 2014; 2:4; and Clinical Trial Identifier No. NCT00397579.

In another embodiment, the CD123 inhibitor is an anti-CD123 antibody or fragment thereof. In one embodiment, the anti-CD123 antibody or fragment thereof comprises a monoclonal antibody, e.g., a monospecific or bispecific antibody or fragment thereof. For example, the anti-CD123 antibody or fragment thereof comprises CSL360 (CSL Limited). CSL360 is a recombinant chimeric monoclonal antibody that binds to CD123. In some embodiments, CSL360 is administered intravenously, e.g., by intravenous infusion. For example, CSL360 is administered at a dose of 0.1-10 mg/kg, e.g., 0.1-0.5 mg/kg, 0.5-1 mg/kg, 1-5 mg/kg, or 5-10 mg/kg. See, e.g., Clinical Trial Identifier No. NCT01632852; and Testa et al.

In another embodiment, the CD123 antibody or fragment thereof comprises CSL362 (CSL Limited). CSL362 is a humanized monoclonal antibody that targets the CD123 and is optimized for enhanced activation of antibody dependent cell-mediated cytotoxicity (ADCC). In some embodiments, CSL362 is administered intravenously, e.g., by intravenous infusion. In some examples, CSL362 is administered at a dose of 0.1-12 mg/kg, e.g., 0.1-0.2 mg/kg, 0.2-0.5 mg/kg, 0.5-1 mg/kg, 1-6 mg/kg, or 6-12 mg/kg. See, e.g., Clinical Trial Identifier No. NCT01632852.

In one embodiment, the CD123 antibody or fragment thereof comprises a bispecific antibody, e.g., MGD006

(MacroGenics). MGD006 is a bispecific antibody that targets CD123 and CD3. See, e.g., Clinical Trial Identifier No. NCT02152956.

In some embodiments, the CD123 inhibitor is conjugated or otherwise bound to a therapeutic agent.

In some embodiments, a CD123 inhibitor includes an anti-CD123 CAR-expressing cell, e.g., CART, e.g., a cell expressing an anti-CD123 CAR construct or encoded by a CD123 binding CAR comprising a scFv, CDRs, or VH and VL chains. For example, an anti-CD123 CAR-expressing cell, e.g., CART is a generated by engineering a CD123-CAR (that comprises a CD123 binding domain) into a cell (e.g., a T cell or NK cell), e.g., for administration in combination with a CAR-expressing cell described herein. In an embodiment, the anti-CD123 CAR construct comprises a scFv sequence, e.g., a scFv sequence provided in US 2014/0322212 A1, incorporated herein by reference. In one embodiment, the anti-CD123 binding domain is a scFv described in US 2014/0322212 A1. In an embodiment, the anti-CD123 binding domain is part of a CAR construct provided in US 2014/0322212 A1. Also provided herein are methods of use of the CAR-expressing cells described herein for adoptive therapy.

In another aspect, provided herein is a population of CAR-expressing cells, e.g., CART cells, comprising a mixture of cells expressing CD19 CARs and CD123 CARs. For example, in one embodiment, the population of CART cells can include a first cell expressing a CD19 CAR and a second cell expressing a CD123 CAR.

CD10 Inhibitors

Cluster of differentiation 10 (CD10) is also called Neprilysin, membrane metallo-endopeptidase (MME), neutral endopeptidase (NEP), and common acute lymphoblastic leukemia antigen (CALLA). CD10 is an enzyme encoded by the membrane metallo-endopeptidase (MME) gene. CD10 is expressed on leukemic cells of pre-B phenotype and is a common acute lymphocytic leukemia antigen.

As used herein, the term "CD10" refers to an antigenic determinant known to be detectable on leukemia cells. The human and murine amino acid and nucleic acid sequences can be found in a public database, such as GenBank, UniProt and Swiss-Prot. For example, the amino acid sequences of human CD10 can be found at Accession Nos. NP_009218.2; NP_000893.2; NP_009219.2; NP_009220.2, and the mRNA sequences encoding them can be found at Accession Nos. NM_007287.2 (variant ibis); NM_000902.3 (variant 1); NM_007288.2 (variant 2a); NM_007289.2 (variant 2b). As used herein, "CD10" includes proteins comprising mutations, e.g., point mutations, fragments, insertions, deletions and splice variants of full length wild-type CD10. In one aspect the antigen-binding portion of the CAR recognizes and binds an antigen within the extracellular domain of the CD10 protein. In one aspect, the CD10 protein is expressed on a cancer cell.

Also provided herein are CD10 inhibitors and combination therapies. CD10 inhibitors include but are not limited to small molecules, recombinant proteins, anti-CD10 CAR-expressing cells, e.g. CARTs, and anti-CD10 antibodies (e.g., an anti-CD10 mono- or bispecific antibody) and fragments thereof. In some embodiments, anti-CD10 inhibitors can be used to treat a B-cell malignancy described herein. In an embodiment, the CD10 inhibitor is administered in combination with a CD19 inhibitor, e.g., a CD19 CAR-expressing cell, e.g., a CAR-expressing cell described herein, e.g., a cell expressing a CAR comprising an antibody binding domain that is murine, human, or humanized.

In an embodiment, the CD10 inhibitor comprises sacubitril (AHU-377; Novartis) (4-{[(2S,4R)-1-(4-Biphenylyl)-5-ethoxy-4-methyl-5-oxo-2-pentanyl]amino}-4-oxobutanoic acid), or a pharmaceutically acceptable salt or a derivative thereof. The structure of sacubitril is shown below.

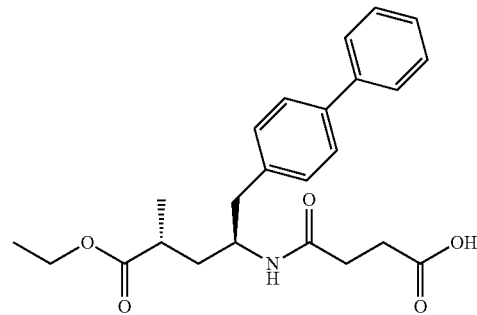 [SMILES: CCOC(=O)[C@H](C)C[C@@H](Cc1ccc(-c2ccccc2)cc1)NC(=O)CCC(=O)O]

In another embodiment, the CD10 inhibitor comprises valsartan/sacubritril (LCZ696; Novartis) or a pharmaceutically acceptable salt or a derivative thereof. Valsartan/sacubitril is a combination drug comprising a 1:1 mixture of valsartan and sacubitril. The structure of valsartan ((S)-3-methyl-2-(N-{[2'-(2H-1,2,3,4-tetrazol-5-yl)biphenyl-4-yl]methyl}pentanamido)butanoic acid) is shown below.

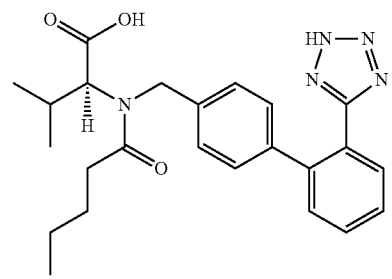 [SMILES: CCCCC(=O)N(Cc1ccc(-c2ccccc2-c2nn[nH]n2)cc1)[C@H](C(=O)O)C(C)C]

In an embodiment, the CD10 inhibitor comprises omapatrilat (Bristol-Myers Squibb) ((4S,7S,10aS)-5-oxo-4-{[(2S)-3-phenyl-2-sulfanylpropanoyl]amino}-2,3,4,7,8,9,10,10a-octahydropyrido[6,1-b][1,3]thiazepine-7-carboxylic acid), or a pharmaceutically acceptable salt or a derivative thereof. The structure of omapatrilat is shown below.

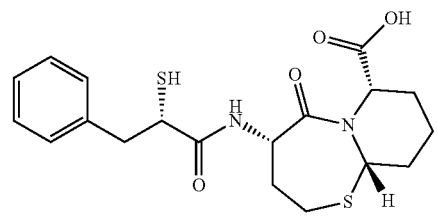 [SMILES: O=C(N[C@H]1CCS[C@H]2CCC[C@@H](C(=O)O)N2C1=O)[C@@H](S)Cc1ccccc1]

In an embodiment, the CD10 inhibitor comprises RB-101 (benzyl N-(3-{[2S)-2-amino-4-(methylthio)butyl]dithio}-2-benzylpropanoyl)-L-phenylalaninate), or a pharmaceutically acceptable salt or a derivative thereof. The structure of RB-101 is shown below.

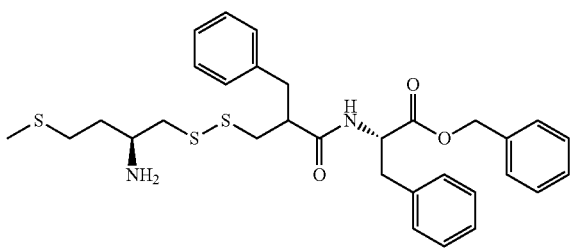 [SMILES: CSCC[C@H](N)CSSCC(Cc1ccccc1)C(=O)N[C@@H](Cc1ccccc1)C(=O)OCc1ccccc1]

In an embodiment, the CD10 inhibitor comprises UK-414,495 (Pfizer) ((R)-2-({1-[(5-ethyl-1,3,4-thiadiazol-2-yl)carbamoyl]cyclopentyl}methyl)valeric acid), or a pharmaceutically acceptable salt or a derivative thereof. The structure of UK-414,495 is shown below.

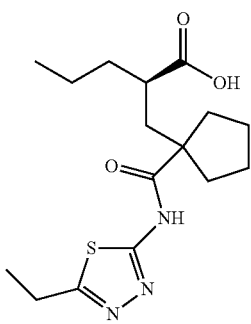 [SMILES: CCC[C@H](CC1(C(=O)Nc2nnc(CC)s2)CCCC1)C(=O)O]

In some embodiments, the CD10 inhibitor is conjugated or otherwise bound to a therapeutic agent.

In some embodiments, a CD10 inhibitor includes an anti-CD10 CAR-expressing cell, e.g., CART, e.g., a cell expressing an anti-CD10 CAR construct or encoded by a CD10 binding CAR comprising a scFv, CDRs, or VH and VL chains. For example, an anti-CD10 CAR-expressing cell, e.g., CART is a generated by engineering a CD10-CAR (that comprises a CD10 binding domain) into a cell (e.g., a T cell or NK cell), e.g., for administration in combination with a CAR-expressing cell described herein. Also provided herein are methods of use of the CAR-expressing cells described herein for adoptive therapy.

In another aspect, provided herein is a population of CAR-expressing cells, e.g., CART cells, comprising a mixture of cells expressing CD19 CARs and CD10 CARs. For example, in one embodiment, the population of CART cells can include a first cell expressing a CD19 CAR and a second cell expressing a CD10 CAR.

CD34 Inhibitors

Cluster of differentiation 34 (CD34) is also called hematopoietic progenitor cell antigen CD34 and is a cell surface glycoprotein that functions as a cell-cell adhesion factor. CD34 is sometimes expressed on some cancers/tumors, e.g., alveolar soft part sarcoma, preB-ALL, AML, AML-M7, dermatofibrosarcoma protuberans, gastrointestinal stromal tumors, giant cell fibroblastoma, granulocytic sarcoma, Kaposi's sarcoma, liposarcoma, malignant fibrous histiocytoma, malignant peripheral nerve sheath tumors, mengingeal hemangiopericytomas, meningiomas, neurofibromas, schwannomas, and papillary thyroid carcinoma.

As used herein, the term "CD34" refers to an antigenic determinant known to be detectable on hematopoietic stem cells and some cancer cells. The human and murine amino acid and nucleic acid sequences can be found in a public database, such as GenBank, UniProt and Swiss-Prot. For example, the amino acid sequences of human CD34 can be found at Accession Nos. NP_001020280.1 (isoform a precursor); NP_001764.1 (isoform b precursor), and the mRNA sequences encoding them can be found at Accession Nos. NM_001025109.1 (variant 1); NM_001773.2 (variant 2). As used herein, "CD34" includes proteins comprising mutations, e.g., point mutations, fragments, insertions, deletions and splice variants of full length wild-type CD34. In one aspect the antigen-binding portion of the CAR recognizes and binds an antigen within the extracellular domain of the CD34 protein. In one aspect, the CD34 protein is expressed on a cancer cell.

Also provided herein are CD34 inhibitors and combination therapies. CD34 inhibitors include but are not limited to small molecules, recombinant proteins, anti-CD34 CAR-expressing cells, e.g. CARTs, and anti-CD34 antibodies (e.g., an anti-CD34 mono- or bispecific antibody) and fragments thereof. In some embodiments, anti-CD34 inhibitors can be used to treat a B-cell malignancy described herein. In an embodiment, the CD34 inhibitor is administered in combination with a CD19 inhibitor, e.g., a CD19 CAR-expressing cell, e.g., a CAR-expressing cell described herein, e.g., a cell expressing a CAR comprising an antibody binding domain that is murine, human, or humanized.

In an embodiment, the CD34 inhibitor comprises an antibody or fragment thereof, e.g., the My-10 monoclonal antibody or an immunoliposome comprising the My-10 monoclonal antibody, as described in Mercadal et al. Biochim. Biophys. Acta. 1371.1(1998):17-23. In other embodiments, the CD34 inhibitor comprises an immunoliposome containing a cancer drug, e.g., doxorubicin, that is targeted to CD34-expressing cells, as described in Carrion et al. Life Sci. 75.3(2004):313-28. In an embodiment, the CD34 inhibitor comprises a monoclonal antibody against CD34 as described in Maleki et al. Hum. Antibodies. 22(2013):1-8. In another embodiment, the CD34 inhibitor comprises a monoclonal antibody that targets CD34, as described in Maleki et al. Cell J. 16.3(2014):361-66.

In some embodiments, the CD34 inhibitor is conjugated or otherwise bound to a therapeutic agent.

In some embodiments, a CD34 inhibitor includes an anti-CD34 CAR-expressing cell, e.g., CART, e.g., a cell expressing an anti-CD34 CAR construct or encoded by a CD34 binding CAR comprising a scFv, CDRs, or VH and VL chains. For example, an anti-CD34 CAR-expressing cell, e.g., CART is a generated by engineering a CD34-CAR (that comprises a CD34 binding domain) into a cell (e.g., a T cell or NK cell), e.g., for administration in combination with a CAR-expressing cell described herein. Also provided herein are methods of use of the CAR-expressing cells described herein for adoptive therapy.

In another aspect, provided herein is a population of CAR-expressing cells, e.g., CART cells, comprising a mixture of cells expressing CD19 CARs and CD34 CARs. For example, in one embodiment, the population of CART cells can include a first cell expressing a CD19 CAR and a second cell expressing a CD34 CAR.

FLT-3 Inhibitors

Fms-like tyrosine kinase 3 (FLT-3), also called Cluster of differentiation antigen 135 (CD135), receptor-type tyrosine-protein kinase FLT3, or fetal liver kinase-2 (Flk2), is a receptor tyrosine kinase. FLT-3 is a cytokine receptor for the ligand, cytokine Flt3 ligand (FLT3L). FLT-3 is expressed on the surface of many hematopoietic progenitor cells and is important for lymphocyte development. The FLT3 gene is commonly mutated in leukemia, e.g., acute myeloid leukemia (AML).

As used herein, the term "FLT-3" refers to an antigenic determinant known to be detectable on hematopoietic progenitor cells and some cancer cells, e.g., leukemia cells. The human and murine amino acid and nucleic acid sequences can be found in a public database, such as GenBank, UniProt and Swiss-Prot. For example, the amino acid sequences of human FLT-3 can be found at Accession Nos. NP_004110.2, and the mRNA sequences encoding them can be found at Accession Nos. NM_004119.2. As used herein, "FLT-3" includes proteins comprising mutations, e.g., point mutations, fragments, insertions, deletions and splice variants of full length wild-type FLT-3. In one aspect the antigen-binding portion of the CAR recognizes and binds an antigen within the extracellular domain of the FLT-3 protein. In one aspect, the FLT-3 protein is expressed on a cancer cell.

Also provided herein are FLT-3 inhibitors and combination therapies. FLT-3 inhibitors include but are not limited to small molecules, recombinant proteins, anti-FLT-3 CAR-expressing cells, e.g. CARTs, and anti-FLT-3 antibodies (e.g., an anti-FLT-3 mono- or bispecific antibody) and fragments thereof. In some embodiments, anti-FLT-3 inhibitors can be used to treat a B-cell malignancy described herein. In an embodiment, the FLT-3 inhibitor is administered in combination with a CD19 inhibitor, e.g., a CD19 CAR-expressing cell, e.g., a CAR-expressing cell described herein, e.g., a cell expressing a CAR comprising an antibody binding domain that is murine, human, or humanized.

In some embodiments, the FLT-3 inhibitor comprises quizartinib (AC220; Ambit Biosciences) or a pharmaceutically acceptable salt or a derivative thereof. Quizartinib is a small molecule receptor tyrosine kinase inhibitor. The structure of quizartinib (1-(5-(tert-Butyl)isoxazol-3-yl)-3-(4-(7-(2-morpholinoethoxy)benzo[d]imidazo[2,1-b]thiazol-2-yl)phenyl)urea) is shown below.

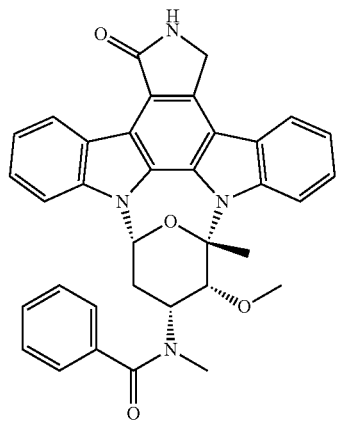

In some embodiments, midostaurin is administered orally, e.g., at a dose of about 25-200 mg, e.g., about 25-50 mg, 50-100 mg, 100-150 mg, or 150-200 mg. For example, midostaurin is administered, e.g., orally, at a dose of about 25-200 mg twice daily, e.g., about 25-50 mg, 50-100 mg, 100-150 mg, or 150-200 mg twice daily. See, e.g., Clinical Trial Identifier No. NCT01830361.

In an embodiment, the FLT-3 inhibitor comprises sorafenib (Bayer and Onyx Pharmaceuticals) or a pharmaceutically acceptable salt or a derivative thereof. Sorafenib is a small molecular inhibitor of multiple tyrosine protein kinases (e.g., VEGFR and PDGFR), Raf kinases (e.g., C-Raf and B-Raf), and some intracellular serine/threonine kinases (e.g. C-Raf, wild-type B-Raf, and mutant B-Raf). See, e.g., labeling.bayerhealthcare.com/html/products/pi/Nexavar_PI.pdf. The structure of sorafenib (4-[4-[[4-chloro-3-(trifluoromethyl)phenyl]carbamoylamino]phenoxy]-N-methyl-pyridine-2-carboxamide) is shown below.

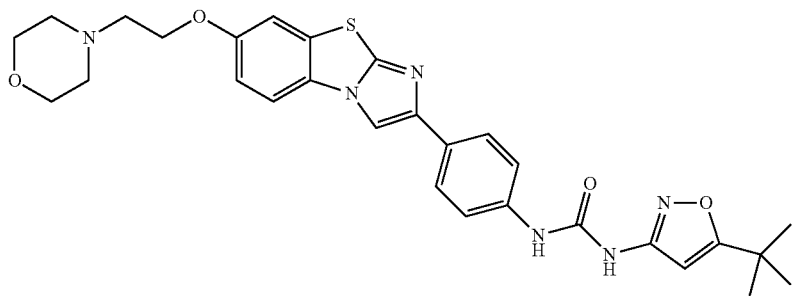 [SMILES: CC(C)(C)c1cc(NC(=O)Nc2ccc(-c3cn4c(n3)sc3cc(OCCN5CCOCC5)ccc34)cc2)no1]

In some embodiments, the FLT-3 inhibitor comprises midostaurin is (PKC412; Technische Universitat Dresden) or a pharmaceutically acceptable salt or a derivative thereof. Midostaurin is a protein kinase inhibitor that is a semi-synthetic derivative of staurosporine, an alkaloid from the bacterium *Streptomyces staurosporeus*.

The structure of midostaurin ((9S,10R,11R,13R)-2,3,10,11,12,13-Hexahydro-10-methoxy-9-methyl-11-(methylamino)-9,13-epoxy-1H,9H-diindolo[1,2,3-gh:3',2',1'-lm]pyrrolo[3,4-j][1,7]benzodiamzonine-1-one) is shown below.

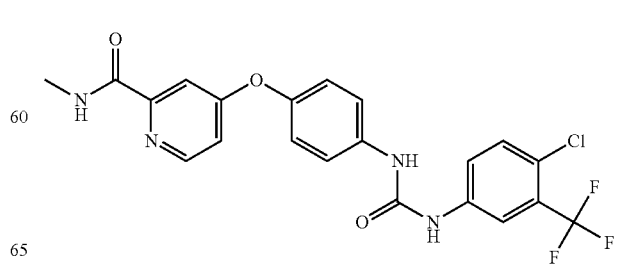

In some embodiments, the FLT-3 inhibitor comprises sunitinib (previously known as SU11248; Pfizer) or a pharmaceutically acceptable salt or derivative thereof. Sunitinib is a small molecule oral drug that inhibits multiple receptor tyrosine kinases, including FLT3. Sunitinib has been approved by the Food and Drug Administration (FDA) for the treatment of renal cell carcinoma (RCC) and imatinib-resistant gastrointestinal stromal tumor (GIST). The structure of sunitinib (N-(2-diethylaminoethyl)-5-[(Z)-(5-fluoro-2-oxo-1H-indol-3-ylidene)methyl]-2,4-dimethyl-1H-pyrrole-3-carboxamide) is shown below.

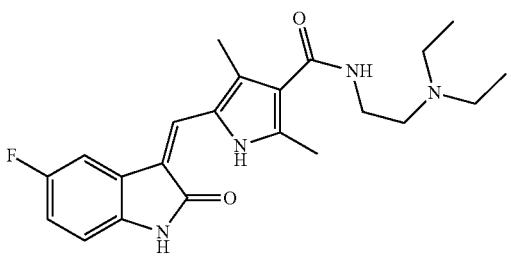 [SMILES: CCN(CC)CCNC(=O)c1c(C)[nH]c(/C=C2\C(=O)Nc3ccc(F)cc32)c1C]

In some embodiments, the FLT-3 inhibitor comprises lestaurtinib (CEP-701; Cephalon) or a pharmaceutically acceptable salt or derivative thereof. Lestaurtinib is a tyrosine kinase inhibitor that is structurally related to staurosporine. The structure of lestaurtinib ((9S,10S,12R)-2,3,9,10,11,12-Hexahydro-10-hydroxy-10-(hydroxymethyl)-9-methyl-9,12-epoxy-1H-diindolo[1,2,3-fg:3',2',1'-kl]pyrrolo[3,4-i][1,6]benzodiazocin-1-one) is shown below.

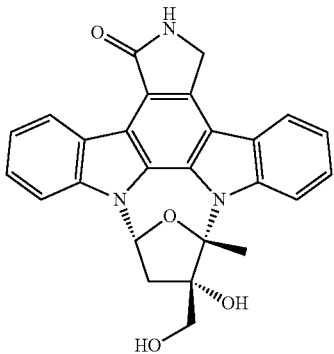 [SMILES: C[C@]12O[C@H](C[C@]1(O)CO)n1c3ccccc3c3c4c(c5c6ccccc6n2c5c31)CNC4=O]

In some embodiments, lestaurtinib is administered orally, e.g., at a dose of about 40-100 mg twice a day, e.g., about 40-60 mg, 50-70 mg, 60-80 mg, 70-90 mg, or 80-100 mg twice a day. See, e.g., Clinical Trial Identifier No. NCT00079482; or NCT00030186.

In some embodiments, the FLT-3 inhibitor is conjugated or otherwise bound to a therapeutic agent.

In some embodiments, a FLT-3 inhibitor includes an anti-FLT-3 CAR-expressing cell, e.g., CART, e.g., a cell expressing an anti-FLT-3 CAR construct or encoded by a FLT-3 binding CAR comprising a scFv, CDRs, or VH and VL chains. For example, an anti-FLT-3 CAR-expressing cell, e.g., CART is a generated by engineering a FLT-3-CAR (that comprises a FLT-3 binding domain) into a cell (e.g., a T cell or NK cell), e.g., for administration in combination with a CAR-expressing cell described herein. Also provided herein are methods of use of the CAR-expressing cells described herein for adoptive therapy.

In another aspect, provided herein is a population of CAR-expressing cells, e.g., CART cells, comprising a mixture of cells expressing CD19 CARs and FLT-3 CARs. For example, in one embodiment, the population of CART cells can include a first cell expressing a CD19 CAR and a second cell expressing a FLT-3 CAR.

In one embodiment the antigen binding domain CAR (e.g., a CD19, ROR1, CD20, CD22, CD123, CD10, CD34, or FLT-3 antigen binding domain) comprises an scFv portion, e.g., a human scFv portion. The scFv may be preceded by an optional leader sequence such as provided in SEQ ID NO: 13, and followed by an optional hinge sequence such as provided in SEQ ID NO: 14 or SEQ ID NO:45 or SEQ ID NO:47 or SEQ ID NO:49, a transmembrane region such as provided in SEQ ID NO:15, an intracellular signaling domain that includes SEQ ID NO:16 or SEQ ID NO:51 and a CD3 zeta sequence that includes SEQ ID NO:17 or SEQ ID NO:43, e.g., wherein the domains are contiguous with and in the same reading frame to form a single fusion protein.

In some embodiments, the present disclosure encompasses a recombinant nucleic acid construct comprising a nucleic acid molecule encoding a CAR (e.g., a CD19 CAR, a ROR1 CAR, a CD20 CAR, a CD22 CAR, a CD123 CAR, a CD10 CAR, a CD34 CAR, or a FLT-3 CAR), wherein the nucleic acid molecule comprises the nucleic acid sequence encoding an antigen binding domain, e.g., described herein, e.g., that is contiguous with and in the same reading frame as a nucleic acid sequence encoding an intracellular signaling domain. An exemplary intracellular signaling domain that can be used in the CAR includes, but is not limited to, one or more intracellular signaling domains of, e.g., CD3-zeta, CD28, 4-1BB, and the like. In some instances, the CAR can comprise any combination of CD3-zeta, CD28, 4-1BB, and the like.

In one embodiment, the antigen binding domain (e.g., a CD19, ROR1, CD20, CD22, CD123, CD10, CD34, or FLT-3 antigen binding domain) is characterized by particular functional features or properties of an antibody or antibody fragment. For example, in one embodiment, the portion of a CAR composition of the invention that comprises an antigen binding domain specifically binds a human B-cell antigen (e.g., CD19, ROR1, CD20, CD22, CD123, CD10, CD34, or FLT-3) or a fragment thereof. In certain embodiments, the scFv is contiguous with and in the same reading frame as a leader sequence. In one aspect the leader sequence is the polypeptide sequence provided as SEQ ID NO:13.

In one embodiment, the antigen binding domain is a fragment, e.g., a single chain variable fragment (scFv). In one embodiments, the antigen binding domain is a Fv, a Fab, a (Fab')2, or a bi-functional (e.g. bi-specific) hybrid antibody (e.g., Lanzavecchia et al., Eur. J. Immunol. 17, 105 (1987)). In one aspect, the antibodies and fragments thereof of the invention binds a B-cell protein or a fragment thereof with wild-type or enhanced affinity. In some instances, a human scFv can be derived from a display library.

In one embodiment, the antigen binding domain, e.g., scFv comprises at least one mutation such that the mutated scFv confers improved stability to the CAR construct. In another embodiment, the antigen binding domain, e.g., scFv comprises at least 1, 2, 3, 4, 5, 6, 7, 8, 9, 10 mutations arising from, e.g., the humanization process such that the mutated scFv confers improved stability to the CAR construct.

In one embodiment, the population of CAR-expressing cells includes, e.g., a first cell expressing a CAR (e.g., a CD19 CAR, a ROR1 CAR, a CD20 CAR, a CD22 CAR, a CD123 CAR, a CD10 CAR, a CD34 CAR, or a FLT-3 CAR)

that includes a primary intracellular signaling domain, and a second cell expressing a CAR (e.g., a CD19 CAR, a ROR1 CAR, a CD20 CAR, a CD22 CAR, a CD123 CAR, a CD10 CAR, a CD34 CAR, or a FLT-3 CAR)) that includes a secondary signaling domain.

CD79b Inhibitors

As used herein, the term "CD79b" refers to an antigenic determinant known to be detectable on some malignant hematological cancer cells, e.g., leukemia cells. The human and murine amino acid and nucleic acid sequences can be found in a public database, such as GenBank, UniProt and Swiss-Prot. For example, the amino acid sequences of human CD79b can be found at Accession Nos. NP_000617.1 (isoform 1 precursor), NP_067613.1 (isoform 2 precursor), or NP_001035022.1 (isoform 3 precursor), and the mRNA sequences encoding them can be found at Accession Nos. NM_000626.2 (transcript variant 1) NM_021602.2 (transcript variant 2), or NM_001039933.1 (transcript variant 3). As used herein, "CD79b" includes proteins comprising mutations, e.g., point mutations, fragments, insertions, deletions and splice variants of full length wild-type CD79b. In one aspect the antigen-binding portion of the CAR recognizes and binds an antigen within the extracellular domain of the CD79b protein. In one aspect, the CD79b protein is expressed on a cancer cell. In embodiments, the CD79b protein is a wild-type CD79b protein; in other embodiments, the CD79b protein is a mutant CD79b protein.

CD79b is also called immunoglobulin-associated beta, which is a component of the B lymphocyte antigen receptor multimeric complex. CD79b forms a heterodimer with another accessory protein called CD79a (immunoglobulin-associated alpha), and the heterodimer complexes with surface immunoglobulins on B cells. CD79b is important for the assembly of and surface expression of the B lymphocyte antigen receptor. CD79b and CD79a are important for pre-B-cell and B-cell development. Mutation and aberrant CD79b expression occurs in many B-CLL cells and may be correlated with the loss of surface expression and/or defective signaling of B lymphocyte antigen receptor in B-CLL. See, e.g., Thompson et al. Blood 90.4(1997):1387-94. In some cases, overexpression of a mutant form or splice variant of CD79b has been correlated with diminished B lymphocyte antigen receptor in B-CLL and other lymphoid malignancies. See, e.g., Cragg et al. Blood 100.9(2002): 3068-76.

Provided herein are CD79b inhibitors and combination therapies. CD79b inhibitors include but are not limited to small molecules, recombinant proteins, anti-CD79b CAR-expressing cells, e.g. CARTs, and anti-CD79b antibodies (e.g., an anti-CD79b mono- or bispecific antibody) and fragments thereof. In some embodiments, anti-CD79b inhibitors can be used to treat a B-cell malignancy described herein. In an embodiment, the CD79b inhibitor is administered in combination with a CD19 inhibitor, e.g., a CD19 CAR-expressing cell, e.g., a CAR-expressing cell described herein, e.g., a cell expressing a CAR comprising an antibody binding domain that is murine, human, or humanized.

In an embodiment, the CD79b inhibitor is an anti-CD79b antibody or fragment thereof. In one embodiment, the anti-79b antibody or fragment thereof comprises a monoclonal antibody, e.g., a monospecific or bispecific antibody or fragment thereof. For example, the anti-CD79b antibody or fragment thereof comprises an anti-CD79b antibody drug conjugate such as polatuzumab vedotin (Roche). In embodiments, polatuzumab vedotin is used to treat a cancer, e.g. NHL, e.g., follicular lymphoma or DLBCL, e.g., relapsed or refractory follicular lymphoma or DLBCL. See, e.g., NCT02257567. In embodiments, the anti-CD79b antibody or fragment thereof is a bispecific antibody comprising components that bind to CD32B and D79B, such as MGD010 (MacroGenics). See, e.g., NCT02376036.

In some embodiments, the CD79b inhibitor is conjugated or otherwise bound to a therapeutic agent.

In some embodiments, a CD79b inhibitor includes an anti-CD79b CAR-expressing cell, e.g., CART, e.g., a cell expressing an anti-CD79b CAR construct or encoded by a CD79b binding CAR comprising a scFv, CDRs, or VH and VL chains. For example, an anti-CD79b CAR-expressing cell, e.g., CART is a generated by engineering a CD79b-CAR (that comprises a CD79b binding domain) into a cell (e.g., a T cell or NK cell), e.g., for administration in combination with a CAR-expressing cell described herein. Also provided herein are methods of use of the CAR-expressing cells described herein for adoptive therapy.

In another aspect, provided herein is a population of CAR-expressing cells, e.g., CART cells or CAR-expressing NK cells, comprising a mixture of cells expressing CD19 CARs and CD79b CARs. For example, in one embodiment, the population of CAR-expressing cells can include a first cell expressing a CD19 CAR and a second cell expressing a CD79b CAR.

C179b Inhibitors

As used herein, the term "CD179b" refers to an antigenic determinant known to be detectable on some malignant hematological cancer cells, e.g., leukemia cells. The human and murine amino acid and nucleic acid sequences can be found in a public database, such as GenBank, UniProt and Swiss-Prot. For example, the amino acid sequences of human CD179b can be found at Accession Nos. NP_064455.1 (isoform a precursor) or NP_690594.1 (isoform b precursor), and the mRNA sequences encoding them can be found at Accession Nos. NM_020070.3 (transcript variant 1) or NM_152855.2 (transcript variant 2). As used herein, "CD179b" includes proteins comprising mutations, e.g., point mutations, fragments, insertions, deletions and splice variants of full length wild-type CD179b. In one aspect the antigen-binding portion of the CAR recognizes and binds an antigen within the extracellular domain of the CD179b protein. In one aspect, the CD179b protein is expressed on a cancer cell. In embodiments, the CD179b protein is a wild-type CD179b protein; in other embodiments, the CD179b protein is a mutant CD179b protein.

CD179b is also called immunoglobulin lambda-like polypeptide 1 (IGLL1). CD179b is a subunit of a heterodimeric light chain that complexes with a membrane-bound Ig mu heavy chain. Together, the light chain and heavy chain form the preB cell receptor. Mutations in CD179b have been correlated with B cell deficiency and agammaglobulinemia. CD179b is expressed in some cancer cells, e.g., precursor B-cell lymphoblastic lymphoma cells.

Provided herein are CD179b inhibitors and combination therapies. CD179b inhibitors include but are not limited to small molecules, recombinant proteins, anti-CD179b CAR-expressing cells, e.g. CARTs, and anti-CD179b antibodies (e.g., an anti-CD179b mono- or bispecific antibody) and fragments thereof. In some embodiments, anti-CD179b inhibitors can be used to treat a B-cell malignancy described herein. In an embodiment, the CD179b inhibitor is administered in combination with a CD20 inhibitor, e.g., a CD19 CAR-expressing cell, e.g., a CAR-expressing cell described herein, e.g., a cell expressing a CAR comprising an antibody binding domain that is murine, human, or humanized.

In an embodiment, the CD179b inhibitor is an anti-CD179b antibody or fragment thereof. In one embodiment, the anti-179b antibody or fragment thereof comprises a monoclonal antibody, e.g., a monospecific or bispecific antibody or fragment thereof.

In some embodiments, the CD179b inhibitor is conjugated or otherwise bound to a therapeutic agent.

In some embodiments, a CD179b inhibitor includes an anti-CD179b CAR-expressing cell, e.g., CART, e.g., a cell expressing an anti-CD179b CAR construct or encoded by a CD179b binding CAR comprising a scFv, CDRs, or VH and VL chains. For example, an anti-CD179b CAR-expressing cell, e.g., CART is a generated by engineering a CD179b-CAR (that comprises a CD179b binding domain) into a cell (e.g., a T cell or NK cell), e.g., for administration in combination with a CAR-expressing cell described herein. Also provided herein are methods of use of the CAR-expressing cells described herein for adoptive therapy.

In another aspect, provided herein is a population of CAR-expressing cells, e.g., CART cells or CAR-expressing NK cells, comprising a mixture of cells expressing CD19 CARs and CD179b CARs. For example, in one embodiment, the population of CAR-expressing cells can include a first cell expressing a CD19 CAR and a second cell expressing a CD179b CAR.

CD79a Inhibitors

As used herein, the term "CD79a" refers to an antigenic determinant known to be detectable on some malignant hematological cancer cells, e.g., leukemia cells. The human and murine amino acid and nucleic acid sequences can be found in a public database, such as GenBank, UniProt and Swiss-Prot. For example, the amino acid sequences of human CD79a can be found at Accession Nos. NP_001774.1 (isoform 1 precursor) or NP_067612.1 (isoform 2 precursor), and the mRNA sequences encoding them can be found at Accession Nos. NM_001783.3 (transcript variant 1) or NM_021601.3 (transcript variant 2). As used herein, "CD79a" includes proteins comprising mutations, e.g., point mutations, fragments, insertions, deletions and splice variants of full length wild-type CD79a. In one aspect the antigen-binding portion of the CAR recognizes and binds an antigen within the extracellular domain of the CD79a protein. In one aspect, the CD79a protein is expressed on a cancer cell. In embodiments, the CD79a protein is a wild-type CD79a protein; in other embodiments, the CD79a protein is a mutant CD79a protein.

CD79a is also called immunoglobulin-associated alpha. CD79a heterodimerizes with CD79b to form a component of the B lymphocyte antigen receptor multimeric complex. CD79a is expressed in many hematological cancers, e.g., acute leukemias (e.g., AML), B-cell Lymphomas, and Myelomas.

Provided herein are CD79a inhibitors and combination therapies. CD79a inhibitors include but are not limited to small molecules, recombinant proteins, anti-CD79a CAR-expressing cells, e.g. CARTs, and anti-CD79a antibodies (e.g., an anti-CD79a mono- or bispecific antibody) and fragments thereof. In some embodiments, anti-CD79a inhibitors can be used to treat a B-cell malignancy described herein. In an embodiment, the CD79a inhibitor is administered in combination with a CD19 inhibitor, e.g., a CD19 CAR-expressing cell, e.g., a CAR-expressing cell described herein, e.g., a cell expressing a CAR comprising an antibody binding domain that is murine, human, or humanized.

In an embodiment, the CD79a inhibitor is an anti-CD79a antibody or fragment thereof. In one embodiment, the anti-CD79a antibody or fragment thereof comprises a monoclonal antibody, e.g., a monospecific or bispecific antibody or fragment thereof. For example, the anti-CD79a antibody or fragment thereof comprises an anti-CD79a antibody or fragment thereof (e.g., variable regions or CDRs) described in Poison et al. Blood 110.2(2007):616-23, incorporated herein by reference. For example, the anti-CD79a antibody or fragment thereof comprises the 7H7, 15E4, or 16C11 antibody or fragment thereof (e.g., variable regions or CDRs) described in Polson et al. See Id.

In some embodiments, the CD79a inhibitor is conjugated or otherwise bound to a therapeutic agent.

In some embodiments, a CD79a inhibitor includes an anti-CD79a CAR-expressing cell, e.g., CART, e.g., a cell expressing an anti-CD79a CAR construct or encoded by a CD79a binding CAR comprising a scFv, CDRs, or VH and VL chains. For example, an anti-CD79a CAR-expressing cell, e.g., CART is a generated by engineering a CD79a-CAR (that comprises a CD79a binding domain) into a cell (e.g., a T cell or NK cell), e.g., for administration in combination with a CAR-expressing cell described herein. Also provided herein are methods of use of the CAR-expressing cells described herein for adoptive therapy.

In another aspect, provided herein is a population of CAR-expressing cells, e.g., CART cells or CAR-expressing NK cells, comprising a mixture of cells expressing CD19 CARs and CD79a CARs. For example, in one embodiment, the population of CAR-expressing cells can include a first cell expressing a CD20 CAR and a second cell expressing a CD79a CAR.

CAR Therapies

The inhibitors herein, e.g., CAR-expressing cells directed against CD10, CD20, CD22, CD34, CD123, FLT-3, ROR1, CD79b, CD179b, or CD79a, may comprise one or more of the compositions described herein, e.g., a transmembrane domain, intracellular signaling domain, costimulatory domain, leader sequence, or hinge.

In one aspect, the present invention encompasses a recombinant nucleic acid construct comprising a transgene encoding a CAR. In some embodiments, the nucleic acid molecule comprises a nucleic acid sequence encoding an anti-CD19 binding domain selected from one or more of SEQ ID NOS:61-72, wherein the sequence is contiguous with and in the same reading frame as the nucleic acid sequence encoding an intracellular signaling domain. An exemplary intracellular signaling domain that can be used in the CAR includes, but is not limited to, one or more intracellular signaling domains of, e.g., CD3-zeta, CD28, 4-1BB, and the like. In some instances, the CAR can comprise any combination of CD3-zeta, CD28, 4-1BB, and the like.

In one aspect, the present invention contemplates modifications of the starting antibody or fragment (e.g., scFv) amino acid sequence that generate functionally equivalent molecules. For example, the VH or VL of an antigen binding domain, e.g., scFv, comprised in the CAR can be modified to retain at least about 70%, 71%. 72%. 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% identity of the starting VH or VL framework region of the antigen binding domain, e.g., scFv. The present invention contemplates modifications of the entire CAR construct, e.g., modifications in one or more amino acid sequences of the various domains of the CAR construct in order to generate functionally equivalent molecules. The CAR construct can be modified to retain at least about 70%, 71%. 72%. 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% identity of the starting CAR construct. The present invention also contemplates modifications of CDRs, e.g., modifications in one or more amino acid sequences of one or more CDRs of a CAR construct in order to generate functionally equivalent molecules. For instance, the CDR may have, e.g., up to and including 1, 2, 3, 4, 5, or 6 alterations (e.g., substitutions) relative to a CDR sequence provided herein.

The nucleic acid sequences coding for the desired molecules can be obtained using recombinant methods known in the art, such as, for example by screening libraries from cells expressing the gene, by deriving the gene from a vector known to include the same, or by isolating directly from cells and tissues containing the same, using standard techniques. Alternatively, the nucleic acid of interest can be produced synthetically, rather than cloned.

The present invention includes, among other things, retroviral and lentiviral vector constructs expressing a CAR that can be directly transduced into a cell.

The present invention also includes an RNA construct that can be directly transfected into a cell. A method for generating mRNA for use in transfection involves in vitro transcription (IVT) of a template with specially designed primers, followed by polyA addition, to produce a construct containing 3' and 5' untranslated sequence ("UTR"), a 5' cap and/or Internal Ribosome Entry Site (IRES), the nucleic acid to be expressed, and a polyA tail, typically 50-2000 bases in length (SEQ ID NO:118). RNA so produced can efficiently transfect different kinds of cells. In one embodiment, the template includes sequences for the CAR. In an embodiment, an RNA CAR vector is transduced into a T cell by electroporation.

Antigen Binding Domain

In one aspect, the CAR of the invention comprises a target-specific binding element otherwise referred to as an antigen binding domain. The choice of moiety depends upon the type and number of ligands that define the surface of a target cell. For example, the antigen binding domain may be chosen to recognize a ligand that acts as a cell surface marker on target cells associated with a particular disease state. Thus examples of cell surface markers that may act as ligands for the antigen binding domain in a CAR of the invention include those associated with viral, bacterial and parasitic infections, autoimmune disease and cancer cells. The antigen-binding domain can bind, e.g., one or more of CD10, CD19, CD20, CD22, CD34, CD123, FLT-3, ROR1, CD79b, CD179b, or CD79a.

In one aspect, the CAR-mediated T-cell response can be directed to an antigen of interest by way of engineering an antigen binding domain that specifically binds a desired antigen into the CAR.

The antigen binding domain (e.g., an antigen-binding domain that binds one or more of CD10, CD19, CD20, CD22, CD34, CD123, FLT-3, ROR1, CD79b, CD179b, or CD79a) can be any domain that binds to the antigen including but not limited to a monoclonal antibody, a polyclonal antibody, a recombinant antibody, a murine antibody, a human antibody, a humanized antibody, and a functional fragment thereof, including but not limited to a single-domain antibody such as a heavy chain variable domain (VH), a light chain variable domain (VL) and a variable domain (VHH) of camelid derived nanobody, and to an alternative scaffold known in the art to function as antigen binding domain, such as a recombinant fibronectin domain, and the like.

In some instances, it is beneficial for the antigen binding domain to be derived from the same species in which the CAR will ultimately be used in. For example, for use in humans, it may be beneficial for the antigen binding domain (e.g., an antigen-binding domain that binds one or more of CD10, CD19, CD20, CD22, CD34, CD123, FLT-3, ROR1, CD79b, CD179b, or CD79a) of the CAR to comprise human or humanized residues for the antigen binding domain of an antibody or antibody fragment.

A humanized antibody can be produced using a variety of techniques known in the art, including but not limited to, CDR-grafting (see, e.g., European Patent No. EP 239,400; International Publication No. WO 91/09967; and U.S. Pat. Nos. 5,225,539, 5,530,101, and 5,585,089, each of which is incorporated herein in its entirety by reference), veneering or resurfacing (see, e.g., European Patent Nos. EP 592,106 and EP 519,596; Padlan, 1991, Molecular Immunology, 28(4/5):489-498; Studnicka et al., 1994, Protein Engineering, 7(6):805-814; and Roguska et al., 1994, PNAS, 91:969-973, each of which is incorporated herein by its entirety by reference), chain shuffling (see, e.g., U.S. Pat. No. 5,565, 332, which is incorporated herein in its entirety by reference), and techniques disclosed in, e.g., U.S. Patent Application Publication No. US2005/0042664, U.S. Patent Application Publication No. US2005/0048617, U.S. Pat. Nos. 6,407,213, 5,766,886, International Publication No. WO 9317105, Tan et al., J. Immunol., 169:1119-25 (2002), Caldas et al., Protein Eng., 13(5):353-60 (2000), Morea et al., Methods, 20(3):267-79 (2000), Baca et al., J. Biol. Chem., 272(16):10678-84 (1997), Roguska et al., Protein Eng., 9(10):895-904 (1996), Couto et al., Cancer Res., 55 (23 Supp):5973s-5977s (1995), Couto et al., Cancer Res., 55(8):1717-22 (1995), Sandhu J S, Gene, 150(2):409-10 (1994), and Pedersen et al., J. Mol. Biol., 235(3):959-73 (1994), each of which is incorporated herein in its entirety by reference. Often, framework residues in the framework regions will be substituted with the corresponding residue from the CDR donor antibody to alter, for example improve, antigen binding. These framework substitutions are identified by methods well-known in the art, e.g., by modeling of the interactions of the CDR and framework residues to identify framework residues important for antigen binding and sequence comparison to identify unusual framework residues at particular positions. (See, e.g., Queen et al., U.S. Pat. No. 5,585,089; and Riechmann et al., 1988, Nature, 332:323, which are incorporated herein by reference in their entireties.)

A humanized antibody or antibody fragment has one or more amino acid residues remaining in it from a source which is nonhuman. These nonhuman amino acid residues are often referred to as "import" residues, which are typically taken from an "import" variable domain. As provided herein, humanized antibodies or antibody fragments comprise one or more CDRs from nonhuman immunoglobulin molecules and framework regions wherein the amino acid residues comprising the framework are derived completely or mostly from human germline. Multiple techniques for humanization of antibodies or antibody fragments are well-known in the art and can essentially be performed following the method of Winter and co-workers (Jones et al., Nature, 321:522-525 (1986); Riechmann et al., Nature, 332:323-327 (1988); Verhoeyen et al., Science, 239:1534-1536 (1988)), by substituting rodent CDRs or CDR sequences for the corresponding sequences of a human antibody, i.e., CDR-grafting (EP 239,400; PCT Publication No. WO 91/09967; and U.S. Pat. Nos. 4,816,567; 6,331,415; 5,225,539; 5,530, 101; 5,585,089; 6,548,640, the contents of which are incorporated herein by reference herein in their entirety). In such humanized antibodies and antibody fragments, substantially less than an intact human variable domain has been substituted by the corresponding sequence from a nonhuman species. Humanized antibodies are often human antibodies in which some CDR residues and possibly some framework (FR) residues are substituted by residues from analogous sites in rodent antibodies. Humanization of antibodies and antibody fragments can also be achieved by veneering or resurfacing (EP 592,106; EP 519,596; Padlan, 1991, Molecular Immunology, 28(4/5):489-498; Studnicka et al., Protein Engineering, 7(6):805-814 (1994); and Roguska et al., PNAS, 91:969-973 (1994)) or chain shuffling (U.S. Pat. No. 5,565,332), the contents of which are incorporated herein by reference herein in their entirety.

The choice of human variable domains, both light and heavy, to be used in making the humanized antibodies is to reduce antigenicity. According to the so-called "best-fit" method, the sequence of the variable domain of a rodent antibody is screened against the entire library of known human variable-domain sequences. The human sequence which is closest to that of the rodent is then accepted as the human framework (FR) for the humanized antibody (Sims et al., J. Immunol., 151:2296 (1993); Chothia et al., J. Mol. Biol., 196:901 (1987), the contents of which are incorporated herein by reference herein in their entirety). Another method uses a particular framework derived from the consensus sequence of all human antibodies of a particular subgroup of light or heavy chains. The same framework may be used for several different humanized antibodies (see, e.g., Nicholson et al. Mol. Immun. 34 (16-17): 1157-1165 (1997); Carter et al., Proc. Natl. Acad. Sci. USA, 89:4285 (1992); Presta et al., J. Immunol., 151:2623 (1993), the contents of which are incorporated herein by reference herein in their entirety). In some embodiments, the framework region, e.g., all four framework regions, of the heavy chain variable region are derived from a VH4_4-59 germline sequence. In one embodiment, the framework region can comprise, one, two, three, four or five modifications, e.g., substitutions, e.g., from the amino acid at the corresponding murine sequence (e.g., of SEQ ID NO:59). In one embodiment, the framework region, e.g., all four framework regions of the light chain variable region are derived from a VK3_1.25 germline sequence. In one embodiment, the framework region can comprise, one, two, three, four or five modifications, e.g., substitutions, e.g., from the amino acid at the corresponding murine sequence (e.g., of SEQ ID NO:59).

In some aspects, the portion of a CAR composition of the invention that comprises an antibody fragment is humanized with retention of high affinity for the target antigen and other favorable biological properties. According to one aspect of the invention, humanized antibodies and antibody fragments are prepared by a process of analysis of the parental sequences and various conceptual humanized products using three-dimensional models of the parental and humanized sequences. Three-dimensional immunoglobulin models are commonly available and are familiar to those skilled in the art. Computer programs are available which illustrate and display probable three-dimensional conformational structures of selected candidate immunoglobulin sequences. Inspection of these displays permits analysis of the likely role of the residues in the functioning of the candidate immunoglobulin sequence, e.g., the analysis of residues that influence the ability of the candidate immunoglobulin to bind the target antigen. In this way, FR residues can be selected and combined from the recipient and import sequences so that the desired antibody or antibody fragment characteristic, such as increased affinity for the target antigen, is achieved. In general, the CDR residues are directly and most substantially involved in influencing antigen binding.

A humanized antibody or antibody fragment may retain a similar antigenic specificity as the original antibody, e.g., in the present invention, the ability to bind human CD19, CD20, or CD22. In some embodiments, a humanized antibody or antibody fragment may have improved affinity and/or specificity of binding to human CD19, CD20, or CD22.

In one aspect, the binding domain (e.g., an antigen-binding domain that binds one or more of CD10, CD19, CD20, CD22, CD34, CD123, FLT-3, ROR1, CD79b, CD179b, or CD79a) is a fragment, e.g., a single chain variable fragment (scFv). In one aspect, the binding domain is a Fv, a Fab, a (Fab')2, or a bi-functional (e.g. bi-specific) hybrid antibody (e.g., Lanzavecchia et al., Eur. J. Immunol. 17, 105 (1987)). In one aspect, the antibodies and fragments thereof of the invention binds a CD19, CD20, or CD22 protein with wild-type or enhanced affinity.

In some instances, scFvs can be prepared according to method known in the art (see, for example, Bird et al., (1988) Science 242:423-426 and Huston et al., (1988) Proc. Natl. Acad. Sci. USA 85:5879-5883). ScFv molecules can be produced by linking VH and VL regions together using flexible polypeptide linkers. The scFv molecules comprise a linker (e.g., a Ser-Gly linker) with an optimized length and/or amino acid composition. The linker length can greatly affect how the variable regions of a scFv fold and interact. In fact, if a short polypeptide linker is employed (e.g., between 5-10 amino acids) intrachain folding is prevented. Interchain folding is also required to bring the two variable regions together to form a functional epitope binding site. For examples of linker orientation and size see, e.g., Hollinger et al. 1993 Proc Natl Acad. Sci. U.S.A. 90:6444-6448, U.S. Patent Application Publication Nos. 2005/0100543, 2005/0175606, 2007/0014794, and PCT publication Nos. WO2006/020258 and WO2007/024715, is incorporated herein by reference.

An scFv can comprise a linker of at least 1, 2, 3, 4, 5, 6, 7, 8, 9, 10, 11, 12, 13, 14, 15, 16, 17, 18, 19, 20, 25, 30, 35, 40, 45, 50, or more amino acid residues between its VL and VH regions. The linker sequence may comprise any naturally occurring amino acid. In some embodiments, the linker sequence comprises amino acids glycine and serine. In another embodiment, the linker sequence comprises sets of glycine and serine repeats such as $(Gly_4Ser)n$, where n is a positive integer equal to or greater than 1 (SEQ ID NO:18). In one embodiment, the linker can be $(Gly_4Ser)_4$ (SEQ ID NO:106) or $(Gly_4Ser)_3$(SEQ ID NO:107). Variation in the linker length may retain or enhance activity, giving rise to superior efficacy in activity studies.

In some embodiments, the amino acid sequence of the antigen binding domain (e.g., an antigen-binding domain that binds one or more of CD10, CD19, CD20, CD22, CD34, CD123, FLT-3, ROR1, CD79b, CD179b, or CD79a) or other portions or the entire CAR) can be modified, e.g., an amino acid sequence described herein can be modified, e.g., by a conservative substitution. Families of amino acid residues having similar side chains have been defined in the art, including basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine).

Percent identity in the context of two or more nucleic acids or polypeptide sequences, refers to two or more sequences that are the same. Two sequences are "substantially identical" if two sequences have a specified percentage of amino acid residues or nucleotides that are the same (e.g., 60% identity, optionally 70%, 71%. 72%. 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% identity over a specified region, or, when not specified, over the entire sequence), when compared and aligned for maximum correspondence over a comparison window, or designated region as measured using one of the following sequence comparison algorithms or by manual alignment and visual inspection. Optionally, the identity exists over a region that is at least about 50 nucleotides (or 10 amino acids) in length, or over a region that is 100 to 500 or 1000 or more nucleotides (or 20, 50, 200 or more amino acids) in length.

For sequence comparison, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Default program parameters can be used, or alternative parameters can be designated. The sequence comparison algorithm then calculates the percent sequence identities for the test sequences relative to the reference sequence, based on the program parameters. Methods of alignment of sequences for comparison are well known in the art. Optimal alignment of sequences for comparison can be conducted, e.g., by the local homology algorithm of Smith and Waterman, (1970) Adv. Appl. Math. 2:482c, by the homology alignment algorithm of Needleman and Wunsch, (1970) J. Mol. Biol. 48:443, by the search for similarity method of Pearson and Lipman, (1988) Proc. Nat'l. Acad. Sci. USA 85:2444, by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection (see, e.g., Brent et al., (2003) Current Protocols in Molecular Biology).

Two examples of algorithms that are suitable for determining percent sequence identity and sequence similarity are the BLAST and BLAST 2.0 algorithms, which are described in Altschul et al., (1977) Nuc. Acids Res. 25:3389-3402; and Altschul et al., (1990) J. Mol. Biol. 215:403-410, respectively. Software for performing BLAST analyses is publicly available through the National Center for Biotechnology Information.

The percent identity between two amino acid sequences can also be determined using the algorithm of E. Meyers and W. Miller, (1988) Comput. Appl. Biosci. 4:11-17) which has been incorporated into the ALIGN program (version 2.0), using a PAM120 weight residue table, a gap length penalty of 12 and a gap penalty of 4. In addition, the percent identity between two amino acid sequences can be determined using the Needleman and Wunsch (1970) J. Mol. Biol. 48:444-453) algorithm which has been incorporated into the GAP program in the GCG software package (available at www.gcg.com), using either a Blossom 62 matrix or a PAM250 matrix, and a gap weight of 16, 14, 12, 10, 8, 6, or 4 and a length weight of 1, 2, 3, 4, 5, or 6.

In one aspect, the present invention contemplates modifications of the starting antibody or fragment (e.g., scFv) amino acid sequence that generate functionally equivalent molecules. For example, the VH or VL of a binding domain (e.g., an antigen-binding domain that binds one or more of CD10, CD19, CD20, CD22, CD34, CD123, FLT-3, ROR1, CD79b, CD179b, or CD79a), e.g., scFv, comprised in the CAR can be modified to retain at least about 70%, 71%. 72%. 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% identity of the starting VH or VL framework region of the anti-CD19 binding domain, e.g., scFv. More broadly, the VH or VL of a B-cell antigen binding domain, to CD10, CD20, CD22, CD34, CD123, FLT-3, or ROR1, e.g., scFv, comprised in the CAR can be modified to retain at least about 70%, 71%. 72%. 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% identity of the starting VH or VL framework region of the antigen binding domain, e.g., scFv. The present invention contemplates modifications of the entire CAR construct, e.g., modifications in one or more amino acid sequences of the various domains of the CAR construct in order to generate functionally equivalent molecules. The CAR construct can be modified to retain at least about 70%, 71%. 72%. 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% identity of the starting CAR construct.

Bispecific CARs

In an embodiment a multispecific antibody molecule is a bispecific antibody molecule. A bispecific antibody has specificity for no more than two antigens. A bispecific antibody molecule is characterized by a first immunoglobulin variable domain sequence which has binding specificity for a first epitope and a second immunoglobulin variable domain sequence that has binding specificity for a second epitope. In an embodiment the first and second epitopes are on the same antigen, e.g., the same protein (or subunit of a multimeric protein). In an embodiment the first and second epitopes overlap. In an embodiment the first and second epitopes do not overlap. In an embodiment the first and second epitopes are on different antigens, e.g., different proteins (or different subunits of a multimeric protein). In an embodiment a bispecific antibody molecule comprises a heavy chain variable domain sequence and a light chain variable domain sequence which have binding specificity for a first epitope and a heavy chain variable domain sequence and a light chain variable domain sequence which have binding specificity for a second epitope. In an embodiment a bispecific antibody molecule comprises a half antibody having binding specificity for a first epitope and a half antibody having binding specificity for a second epitope. In an embodiment a bispecific antibody molecule comprises a half antibody, or fragment thereof, having binding specificity for a first epitope and a half antibody, or fragment thereof, having binding specificity for a second epitope. In an embodiment a bispecific antibody molecule comprises a scFv, or fragment thereof, have binding specificity for a first epitope and a scFv, or fragment thereof, have binding specificity for a second epitope. In an embodiment the first epitope is located on CD19 and the second epitope is located on CD10, CD20, CD22, CD34, CD123, FLT-3, or ROR1.

In certain embodiments, the antibody molecule is a multispecific (e.g., a bispecific or a trispecific) antibody molecule. Protocols for generating bispecific or heterodimeric antibody molecules are known in the art; including but not limited to, for example, the "knob in a hole" approach described in, e.g., U.S. Pat. No. 5,731,168; the electrostatic steering Fc pairing as described in, e.g., WO 09/089004, WO 06/106905 and WO 2010/129304; Strand Exchange Engineered Domains (SEED) heterodimer formation as described in, e.g., WO 07/110205; Fab arm exchange as described in, e.g., WO 08/119353, WO 2011/131746, and WO 2013/060867; double antibody conjugate, e.g., by antibody cross-linking to generate a bi-specific structure using a heterobifunctional reagent having an amine-reactive group and a sulfhydryl reactive group as described in, e.g., U.S. Pat. No. 4,433,059; bispecific antibody determinants generated by recombining half antibodies (heavy-light chain pairs or Fabs) from different antibodies through cycle of reduction and oxidation of disulfide bonds between the two heavy chains, as described in, e.g., U.S. Pat. No. 4,444,878; trifunctional antibodies, e.g., three Fab' fragments cross-linked through sulfhdryl reactive groups, as described in, e.g., U.S. Pat. No. 5,273,743; biosynthetic binding proteins, e.g., pair of scFvs cross-linked through C-terminal tails preferably through disulfide or amine-reactive chemical cross-linking, as described in, e.g., U.S. Pat. No. 5,534,254; bifunctional antibodies, e.g., Fab fragments with different binding specificities dimerized through leucine zippers (e.g., c-fos and c-jun) that have replaced the constant domain, as described in, e.g., U.S. Pat. No. 5,582,996; bispecific and oligospecific mono- and oligovalent receptors, e.g., VH-CH1 regions of two antibodies (two Fab fragments) linked through a polypeptide spacer between the CH1 region of one antibody and the VH region of the other antibody typically with associated light chains, as described in, e.g., U.S. Pat. No. 5,591,828; bispecific DNA-antibody conjugates, e.g., crosslinking of antibodies or Fab fragments through a double stranded piece of DNA, as described in, e.g., U.S. Pat. No. 5,635,602; bispecific fusion proteins, e.g., an expression construct containing two scFvs with a hydrophilic helical peptide linker between them and a full constant region, as described in, e.g., U.S. Pat. No. 5,637,481; multivalent and multispecific binding proteins, e.g., dimer of polypeptides having first domain with binding region of Ig heavy chain variable region, and second domain with binding region of Ig light chain variable region, generally termed diabodies (higher order structures are also encompassed creating for bispecific, trispecific, or tetraspecific molecules, as described in, e.g., U.S. Pat. No. 5,837,242; minibody constructs with linked VL and VH chains further connected with peptide spacers to an antibody hinge region and CH3 region, which can be dimerized to form bispecific/multivalent molecules, as described in, e.g., U.S. Pat. No. 5,837,821; VH and VL domains linked with a short peptide linker (e.g., 5 or 10 amino acids) or no linker at all in either orientation, which can form dimers to form bispecific diabodies; trimers and tetramers, as described in, e.g., U.S. Pat. No. 5,844,094; String of VH domains (or VL domains in family members) connected by peptide linkages with cross-linkable groups at the C-terminus further associated with VL domains to form a series of FVs (or scFvs), as described in, e.g., U.S. Pat. No. 5,864,019; and single chain binding polypeptides with both a VH and a VL domain linked through a peptide linker are combined into multivalent structures through non-covalent or chemical crosslinking to form, e.g., homobivalent, heterobivalent, trivalent, and tetravalent structures using both scFV or diabody type format, as described in, e.g., U.S. Pat. No. 5,869,620. Additional exemplary multispecific and bispecific molecules and methods of making the same are found, for example, in U.S. Pat. Nos. 5,910,573, 5,932,448, 5,959,083, 5,989,830, 6,005,079, 6,239,259, 6,294,353, 6,333,396, 6,476,198, 6,511,663, 6,670,453, 6,743,896, 6,809,185, 6,833,441, 7,129,330, 7,183,076, 7,521,056, 7,527,787, 7,534,866, 7,612,181, US2002004587A1, US2002076406A1, US2002103345A1, US2003207346A1, US2003211078A1, US2004219643A1, US2004220388A1, US2004242847A1, US2005003403A1, US2005004352A1, US2005069552A1, US2005079170A1, US2005100543A1, US2005136049A1, US2005136051A1, US2005163782A1, US2005266425A1, US2006083747A1, US2006120960A1, US2006204493A1, US2006263367A1, US2007004909A1, US2007087381A1, US2007128150A1, US2007141049A1, US2007154901A1, US2007274985A1, US2008050370A1, US2008069820A1, US2008152645A1, US2008171855A1, US2008241884A1, US2008254512A1, US2008260738A1, US2009130106A1, US2009148905A1, US2009155275A1, US2009162359A1, US2009162360A1, US2009175851A1, US2009175867A1, US2009232811A1, US2009234105A1, US2009263392A1, US2009274649A1, EP346087A2, WO0006605A2, WO02072635A2, WO04081051A1, WO06020258A2, WO2007044887A2, WO2007095338A2, WO2007137760A2, WO2008119353A1, WO2009021754A2, WO2009068630A1, WO9103493A1, WO9323537A1, WO9409131A1, WO9412625A2, WO9509917A1, WO9637621A2, WO9964460A1. The contents of the above-referenced applications are incorporated herein by reference in their entireties.

Within each antibody or antibody fragment (e.g., scFv) of a bispecific antibody molecule, the VH can be upstream or downstream of the VL. In some embodiments, the upstream antibody or antibody fragment (e.g., scFv) is arranged with its VH ($VH_1$) upstream of its VL ($VL_1$) and the downstream antibody or antibody fragment (e.g., scFv) is arranged with its VL ($VL_2$) upstream of its VH ($VH_2$), such that the overall bispecific antibody molecule has the arrangement $VH_1$-$VL_1$-$VL_2$-$VH_2$. In other embodiments, the upstream antibody or antibody fragment (e.g., scFv) is arranged with its VL ($VL_1$) upstream of its VH ($VH_1$) and the downstream antibody or antibody fragment (e.g., scFv) is arranged with its VH ($VH_2$) upstream of its VL ($VL_2$), such that the overall bispecific antibody molecule has the arrangement $VL_1$-$VH_1$-$VH_2$-$VL_2$. Optionally, a linker is disposed between the two antibodies or antibody fragments (e.g., scFvs), e.g., between $VL_1$ and $VL_2$ if the construct is arranged as $VH_1$-$VL_1$-$VL_2$-$VH_2$, or between $VH_1$ and $VH_2$ if the construct is arranged as $VL_1$-$VH_1$-$VH_2$-$VL_2$. The linker may be a linker as described herein, e.g., a $(Gly_4$-$Ser)n$ linker, wherein n is 1, 2, 3, 4, 5, or 6, e.g., 4 (SEQ ID NO: 53). In general, the linker between the two scFvs should be long enough to avoid mispairing between the domains of the two scFvs. Optionally, a linker is disposed between the VL and VH of the first scFv. Optionally, a linker is disposed between the VL and VH of the second scFv. In constructs that have multiple linkers, any two or more of the linkers can be the same or different. Accordingly, in some embodiments, a bispecific CAR comprises VLs, VHs, and optionally one or more linkers in an arrangement as described herein.

In certain embodiments the antibody molecule is a bispecific antibody molecule having a first binding specificity for a first B-cell epitope and a second binding specificity for another B-cell antigen. For instance, in some embodiments the bispecific antibody molecule has a first binding specificity for CD19 and a second binding specificity for one or more of CD10, CD20, CD22, CD34, CD123, FLT-3, ROR1, CD79b, CD179b, or CD79a. In some embodiments the bispecific antibody molecule has a first binding specificity for CD19 and a second binding specificity for CD22.

Chimeric TCR

In one aspect, the antibodies and antibody fragments disclosed herein (e.g., those directed against CD10, CD19, CD20, CD22, CD34, CD123, FLT-3, ROR1, CD79b, CD179b, or CD79a) can be grafted to one or more constant domain of a T cell receptor ("TCR") chain, for example, a TCR alpha or TCR beta chain, to create an chimeric TCR that binds specifically to a cancer associated antigen. Without being bound by theory, it is believed that chimeric TCRs will signal through the TCR complex upon antigen binding. For example, an scFv as disclosed herein, can be grafted to the constant domain, e.g., at least a portion of the extracellular constant domain, the transmembrane domain and the cytoplasmic domain, of a TCR chain, for example, the TCR alpha chain and/or the TCR beta chain. As another example, an antibody fragment, for example a VL domain as described herein, can be grafted to the constant domain of a TCR alpha chain, and an antibody fragment, for example a VH domain as described herein, can be grafted to the constant domain of a TCR beta chain (or alternatively, a VL domain may be grafted to the constant domain of the TCR beta chain and a VH domain may be grafted to a TCR alpha chain). As another example, the CDRs of an antibody or antibody fragment, e.g., the CDRs of an antibody or antibody fragment as described in any of the Tables herein may be grafted into a TCR alpha and/or beta chain to create a chimeric TCR that binds specifically to a cancer associated antigen. For example, the LC CDRs disclosed herein may be grafted into the variable domain of a TCR alpha chain and the HC CDRs disclosed herein may be grafted to the variable domain of a TCR beta chain, or vice versa. Such chimeric TCRs may be produced by any appropriate method (For example, Willemsen R A et al, Gene Therapy 2000; 7: 1369-1377; Zhang T et al, Cancer Gene Ther 2004; 11: 487-496; Aggen et al, Gene Ther. 2012 April; 19(4):365-74).

Non-Antibody Scaffolds

In embodiments, the antigen binding domain comprises a non antibody scaffold, e.g., a fibronectin, ankyrin, domain antibody, lipocalin, small modular immuno-pharmaceutical, maxybody, Protein A, or affilin. The non antibody scaffold has the ability to bind to target antigen on a cell. In embodiments, the antigen binding domain is a polypeptide or fragment thereof of a naturally occurring protein expressed on a cell. In some embodiments, the antigen binding domain comprises a non-antibody scaffold. A wide variety of non-antibody scaffolds can be employed so long as the resulting polypeptide includes at least one binding region which specifically binds to the target antigen on a target cell.

Non-antibody scaffolds include: fibronectin (Novartis, Mass.), ankyrin (Molecular Partners AG, Zurich, Switzerland), domain antibodies (Domantis, Ltd., Cambridge, Mass., and Ablynx nv, Zwijnaarde, Belgium), lipocalin (Pieris Proteolab AG, Freising, Germany), small modular immuno-pharmaceuticals (Trubion Pharmaceuticals Inc., Seattle, Wash.), maxybodies (Avidia, Inc., Mountain View, Calif.), Protein A (Affibody AG, Sweden), and affilin (gamma-crystallin or ubiquitin) (Scil Proteins GmbH, Halle, Germany).

Fibronectin scaffolds can be based on fibronectin type III domain (e.g., the tenth module of the fibronectin type III ($^{10}$Fn3 domain)). The fibronectin type III domain has 7 or 8 beta strands which are distributed between two beta sheets, which themselves pack against each other to form the core of the protein, and further containing loops (analogous to CDRs) which connect the beta strands to each other and are solvent exposed. There are at least three such loops at each edge of the beta sheet sandwich, where the edge is the boundary of the protein perpendicular to the direction of the beta strands (see U.S. Pat. No. 6,818,418). Because of this structure, this non-antibody scaffold mimics antigen binding properties that are similar in nature and affinity to those of antibodies. These scaffolds can be used in a loop randomization and shuffling strategy in vitro that is similar to the process of affinity maturation of antibodies in vivo.

The ankyrin technology is based on using proteins with ankyrin derived repeat modules as scaffolds for bearing variable regions which can be used for binding to different targets. The ankyrin repeat module is a 33 amino acid polypeptide consisting of two anti-parallel α-helices and a β-turn. Binding of the variable regions is mostly optimized by using ribosome display.

Avimers are derived from natural A-domain containing protein such as HERS. These domains are used by nature for protein-protein interactions and in human over 250 proteins are structurally based on A-domains. Avimers consist of a number of different "A-domain" monomers (2-10) linked via amino acid linkers. Avimers can be created that can bind to the target antigen using the methodology described in, for example, U.S. Patent Application Publication Nos. 20040175756; 20050053973; 20050048512; and 20060008844.

Affibody affinity ligands are small, simple proteins composed of a three-helix bundle based on the scaffold of one of the IgG-binding domains of Protein A. Protein A is a surface protein from the bacterium *Staphylococcus aureus*. This scaffold domain consists of 58 amino acids, 13 of which are randomized to generate affibody libraries with a large number of ligand variants (See e.g., U.S. Pat. No. 5,831,012). Affibody molecules mimic antibodies, they have a molecular weight of 6 kDa, compared to the molecular weight of antibodies, which is 150 kDa. In spite of its small size, the binding site of affibody molecules is similar to that of an antibody.

Protein epitope mimetics (PEM) are medium-sized, cyclic, peptide-like molecules (MW 1-2 kDa) mimicking beta-hairpin secondary structures of proteins, the major secondary structure involved in protein-protein interactions. Antigen binding domains, e.g., those comprising scFv, single domain antibodies, or camelid antibodies, can be directed to any target receptor/ligand described herein, e.g., the PD1 receptors, PD-L1 or PD-L2.

In an embodiment the antigen binding domain comprises the extracellular domain, or a counter-ligand binding fragment thereof, of molecule that binds a counterligand on the surface of a target cell.

An antigen binding domain can comprise the extracellular domain of an inhibitory receptor. Engagement with a counterligand of the coinhibitory molecule is redirected into an optimization of immune effector response.

An antigen binding domain can comprise the extracellular domain of a costimulatory molecule, referred to as a Costimulatory ECD domain, Engagement with a counter ligand of the costimulatory molecule results in optimization of immune effector response.

Transmembrane Domain

With respect to the transmembrane domain, in various embodiments, a CAR can be designed to comprise a transmembrane domain that is attached to the extracellular domain of the CAR. A transmembrane domain can include one or more additional amino acids adjacent to the transmembrane region, e.g., one or more amino acid associated with the extracellular region of the protein from which the transmembrane was derived (e.g., 1, 2, 3, 4, 5, 6, 7, 8, 9, 10 up to 15 amino acids of the extracellular region) and/or one or more additional amino acids associated with the intracellular region of the protein from which the transmembrane protein is derived (e.g., 1, 2, 3, 4, 5, 6, 7, 8, 9, 10 up to 15 amino acids of the intracellular region). In one aspect, the transmembrane domain is one that is associated with one of the other domains of the CAR, e.g., in one embodiment, the transmembrane domain may be from the same protein that the signaling domain, costimulatory domain or the hinge domain is derived from. In another aspect, the transmembrane domain is not derived from the same protein that any other domain of the CAR is derived from. In some instances, the transmembrane domain can be selected or modified by amino acid substitution to avoid binding of such domains to the transmembrane domains of the same or different surface membrane proteins, e.g., to minimize interactions with other members of the receptor complex. In one aspect, the transmembrane domain is capable of homodimerization with another CAR on the cell surface of a CAR-expressing cell. In a different aspect the amino acid sequence of the transmembrane domain may be modified or substituted so as to minimize interactions with the binding domains of the native binding partner present in the same CAR-expressing cell.

The transmembrane domain may be derived either from a natural or from a recombinant source. Where the source is natural, the domain may be derived from any membrane-bound or transmembrane protein. In one aspect the transmembrane domain is capable of signaling to the intracellular domain(s) whenever the CAR has bound to a target. A transmembrane domain of particular use in this invention may include at least the transmembrane region(s) of e.g., the alpha, beta or zeta chain of the T-cell receptor, CD28, CD3 epsilon, CD45, CD4, CD5, CD8, CD9, CD16, CD22, CD33, CD37, CD64, CD80, CD86, CD134, CD137, CD154. In some embodiments, a transmembrane domain may include at least the transmembrane region(s) of, e.g., KIRDS2, OX40, CD2, CD27, LFA-1 (CD11a, CD18), ICOS (CD278), 4-1BB (CD137), GITR, CD40, BAFFR, HVEM (LIGHTR), SLAMF7, NKp80 (KLRF1), NKp44, NKp30, NKp46, CD160, CD19, IL2R beta, IL2R gamma, IL7R α, ITGA1, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, TNFR2, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), SLAMF6 (NTB-A, Ly108), SLAM (SLAMF1, CD150, IPO-3), BLAME (SLAMF8), SELPLG (CD162), LTBR, PAG/Cbp, NKG2D, NKG2C, or CD19.

In some instances, the transmembrane domain can be attached to the extracellular region of the CAR, e.g., the antigen binding domain of the CAR, via a hinge, e.g., a hinge from a human protein. For example, in one embodiment, the hinge can be a human Ig (immunoglobulin) hinge, e.g., an IgG4 hinge, an IgD hinge, a GS linker (e.g., a GS linker described herein), a KIR2DS2 hinge, or a CD8a hinge. In one embodiment, the hinge or spacer comprises (e.g., consists of) the amino acid sequence of SEQ ID NO:14. In one aspect, the transmembrane domain comprises (e.g., consists of) a transmembrane domain of SEQ ID NO: 15.

In one aspect, the hinge or spacer comprises an IgG4 hinge. For example, in one embodiment, the hinge or spacer comprises a hinge of the amino acid sequence ESKYGPP-CPPCPAPEFLGGPSVFLFPPKPKDTLMISRTPEVTCV-VVDVSQEDPEVQFNW YVDGVEVHNAKTKPREEQF-NSTYRVVSVLTVLHQDWLNGKEYKCKVSNKGLPS SIEK TISKAKGQPREPQVYTLPPS QEEMTKNQVSLT-CLVKGFYPSDIAVEWESNGQPENNYK TTPPVLDS-DGSFFLYSRLTVDKSRWQEGNVFSCSVMHEALHN-HYTQKSLSLSLGKM (SEQ ID NO:45). In some embodiments, the hinge or spacer comprises a hinge encoded by a nucleotide sequence of GAGAGCAAG-TACGGCCCTCCCTGCCCCCCTTGCCCTGC-CCCCGAGTTCCTGGGCGG ACCCAGCGTGTTCCT-GTTCCCCCCCAAGCCCAAGGACACCCTGATGATCA GCCGGA CCCCCGAGGTGACCTGTGTGGTGGTG-GACGTGTCCCAGGAGGACCCCGAGGTCCA GTTCAACTGGTACGTGGACGGCGTGGAGGTGCA-CAACGCCAAGACCAAGCCCCGG GAGGAGCAGT-TCAATAGCACCTACCGGGTGGTGTCCGTGCTGAC-CGTGCTGCACCA GGACTGGCTGAACGGCAAGGAATACAAGTG-TAAGGTGTCCAACAAGGGCCTGCCC AGCAGCATC-GAGAAAACCATCAGCAAGGCCAAGGGCCAGC-CTCGGGAGCCCCAGG TGTACACCCTGCCCCCTAGCCAAGAGGAGATGAC-CAAGAACCAGGTGTCCCTGAC CTGCCTGGT-GAAGGGCTTCTACCCCAGCGACATCGCCGTG-GAGTGGGAGAGCAAC GGCCAGCCCGAGAACAACTACAAGACCAC-CCCCCCTGTGCTGGACAGCGACGGCA GCTTCTTC-CTGTACAGCCGGCTGACCGTGGACAAGAGCCG-GTGGCAGGAGGGCAA CGTCTTTAGCTGCTCCGTGATGCACGAGGCCCTG-CACAACCACTACACCCAGAAGA GCCTGAGCCT-GTCCCTGGGCAAGATG (SEQ ID NO:46).

In one aspect, the hinge or spacer comprises an IgD hinge. For example, in one embodiment, the hinge or spacer comprises a hinge of the amino acid sequence RWPESP-KAQASSVPTAQPQAEGSLAKATTAPATTRNTGRG-GEEKKKEKEKEEQEERET KTPECPSHTQPLGVYLLT-PAVQDLWLRDKATFTCFVVGSDLKDAHLTWEVA GKVPTG GVEEGLLERHSNGSQSQHSRLTL-PRSLWNAGTSVTCTLNHPSLPPQRLMALREPAAQA PVKLSLNLLASSDPPEAASWLLCEVS GFSPPNILLM-WLEDQREVNTS GFAPARPPPQPG STTFWAWSVLRV-PAPPSPQPATYTCVVSHEDSRTLL-NASRSLEVSYVTDH (SEQ ID NO:47). In some embodiments, the hinge or spacer comprises a hinge encoded by a nucleotide sequence of AGGTGGC-CCGAAAGTCCCAAGGCCCAGGCATCTAGTGTTC-CTACTGCACAGCCCCA GGCAGAAGGCAGCCTAGC-CAAAGCTACTACTGCACCTGCCACTACGCGCAAT ACT GGCCGTGGCGGGGAGGAGAAGAAAAAGGA-GAAAGAGAAAGAAGAACAGGAAGA GAGGGA-GACCAAGACCCCTGAATGTCCATCCCATACCCAGC-CGCTGGGCGTCTATC TCTTGACTCCCGCAGTACAGGACTTGTGGCTTAGA-GATAAGGCCACCTTTACATGT TTCGTCGTGGGCTCTGACCTGAAGGATGCCCATTT-GACTTGGGAGGTTGCCGGAAA GGTACCCACA-GGGGGGGTTGAGGAAGGGTTGCTGGAGCGCCAT-TCCAATGGCTCT CAGAGCCAGCACTCAAGACTCACCCTTCCGA-GATCCCTGTGGAACGCCGGGACCTC TGTCACATG-TACTCTAAATCATCCTAGCCTGCCCCCACAGCGTCT-GATGGCCCTTAG AGAGCCAGCCGCCCAGGCACCAGTTAAGCTTAGC-CTGAATCTGCTCGCCAGTAGTG ATCCCCCAGAG-GCCGCCAGCTGGCTCTTATGCGAAGTGTCCGGCTT-TAGCCCGCCC AACATCTTGCTCATGTGGCTGGAGGACCAGCGA-GAAGTGAACACCAGCGGCTTCG CTCCAGCCCGGC- CCCCACCCCAGCCGGGTTCTACCACATTCTGGGCCTGGAGTGTCTTAAGGGTCCCAGCACCACCTAGCCCCCAGCCAGCCACATACACCTGTGTTGTGTC CCATGAAGATAGCAGGACCCTGCTAAATGCTTCTAGGAGTCTGGAGGTTTCCTACG TGACTGACCATT (SEQ ID NO:48).

In one aspect, the transmembrane domain may be recombinant, in which case it will comprise predominantly hydrophobic residues such as leucine and valine. In one aspect a triplet of phenylalanine, tryptophan and valine can be found at each end of a recombinant transmembrane domain.

Optionally, a short oligo- or polypeptide linker, between 2 and 10 amino acids in length may form the linkage between the transmembrane domain and the cytoplasmic region of the CAR. A glycine-serine doublet provides a particularly suitable linker. For example, in one aspect, the linker comprises the amino acid sequence of GGGGSGGGGS (SEQ ID NO:49). In some embodiments, the linker is encoded by a nucleotide sequence of GGTGGCGGAGGTTCTGGAGGTGGAGGTTCC (SEQ ID NO:50).

In one aspect, the hinge or spacer comprises a KIR2DS2 hinge.

Cytoplasmic Domain

The cytoplasmic domain or region of the CAR includes an intracellular signaling domain. An intracellular signaling domain is generally responsible for activation of at least one of the normal effector functions of the immune cell in which the CAR has been introduced.

Examples of intracellular signaling domains for use in the CAR of the invention include the cytoplasmic sequences of the T cell receptor (TCR) and co-receptors that act in concert to initiate signal transduction following antigen receptor engagement, as well as any derivative or variant of these sequences and any recombinant sequence that has the same functional capability.

It is known that signals generated through the TCR alone are insufficient for full activation of the T cell and that a secondary and/or costimulatory signal is also required. Thus, T cell activation can be said to be mediated by two distinct classes of cytoplasmic signaling sequences: those that initiate antigen-dependent primary activation through the TCR (primary intracellular signaling domains) and those that act in an antigen-independent manner to provide a secondary or costimulatory signal (secondary cytoplasmic domain, e.g., a costimulatory domain).

A primary signaling domain regulates primary activation of the TCR complex either in a stimulatory way, or in an inhibitory way. Primary intracellular signaling domains that act in a stimulatory manner may contain signaling motifs which are known as immunoreceptor tyrosine-based activation motifs or ITAMs.

Examples of ITAM containing primary intracellular signaling domains that are of particular use in the invention include those of CD3 zeta, common FcR gamma (FCER1G), Fc gamma RIIa, FcR beta (Fc Epsilon Rib), CD3 gamma, CD3 delta, CD3 epsilon, CD79a, CD79b, CD278 (also known as "ICOS"), FcεRI, DAP10, DAP12, and CD66d. In one embodiment, a CAR of the invention comprises an intracellular signaling domain, e.g., a primary signaling domain of CD3-zeta.

In one embodiment, a primary signaling domain comprises a modified ITAM domain, e.g., a mutated ITAM domain which has altered (e.g., increased or decreased) activity as compared to the native ITAM domain. In one embodiment, a primary signaling domain comprises a modified ITAM-containing primary intracellular signaling domain, e.g., an optimized and/or truncated ITAM-containing primary intracellular signaling domain. In an embodiment, a primary signaling domain comprises one, two, three, four or more ITAM motifs.

Further examples of molecules containing a primary intracellular signaling domain that are of particular use in the invention include those of DAP10, DAP12, and CD32.

Costimulatory Signaling Domain

The intracellular signalling domain of the CAR can comprise the CD3-zeta signaling domain by itself or it can be combined with any other desired intracellular signaling domain(s) useful in the context of a CAR of the invention. For example, the intracellular signaling domain of the CAR can comprise a CD3 zeta chain portion and a costimulatory signaling domain. The costimulatory signaling domain refers to a portion of the CAR comprising the intracellular domain of a costimulatory molecule. In one embodiment, the intracellular domain is designed to comprise the signaling domain of CD3-zeta and the signaling domain of CD28. In one aspect, the intracellular domain is designed to comprise the signaling domain of CD3-zeta and the signaling domain of ICOS.

A costimulatory molecule can be a cell surface molecule other than an antigen receptor or its ligands that is required for an efficient response of lymphocytes to an antigen. Examples of such molecules include CD27, CD28, 4-1BB (CD137), OX40, CD30, CD40, PD1, ICOS, lymphocyte function-associated antigen-1 (LFA-1), CD2, CD7, LIGHT, NKG2C, B7-H3, and a ligand that specifically binds with CD83, and the like. For example, CD27 costimulation has been demonstrated to enhance expansion, effector function, and survival of human CART cells in vitro and augments human T cell persistence and antitumor activity in vivo (Song et al. Blood. 2012; 119(3):696-706). Further examples of such costimulatory molecules include MHC class I molecule, TNF receptor proteins, Immunoglobulin-like proteins, cytokine receptors, integrins, signaling lymphocytic activation molecules (SLAM proteins), activating NK cell receptors, BTLA, a Toll ligand receptor, OX40, CD2, CD7, CD27, CD28, CD30, CD40, CDS, ICAM-1, LFA-1 (CD11a/CD18), 4-1BB (CD137), B7-H3, CDS, ICAM-1, ICOS (CD278), GITR, BAFFR, LIGHT, HVEM (LIGHTR), KIRDS2, SLAMF7, NKp80 (KLRF1), NKp44, NKp30, NKp46, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, CD19a, and a ligand that specifically binds with CD83.

The intracellular signaling sequences within the cytoplasmic portion of the CAR of the invention may be linked to each other in a random or specified order. Optionally, a short oligo- or polypeptide linker, for example, between 2 and 10 amino acids (e.g., 2, 3, 4, 5, 6, 7, 8, 9, or 10 amino acids) in length may form the linkage between intracellular signaling sequence. In one embodiment, a glycine-serine doublet can be used as a suitable linker. In one embodiment, a single amino acid, e.g., an alanine, a glycine, can be used as a suitable linker.

In one aspect, the intracellular signaling domain is designed to comprise two or more, e.g., 2, 3, 4, 5, or more, costimulatory signaling domains. In an embodiment, the two or more, e.g., 2, 3, 4, 5, or more, costimulatory signaling domains, are separated by a linker molecule, e.g., a linker molecule described herein. In one embodiment, the intracellular signaling domain comprises two costimulatory signaling domains. In some embodiments, the linker molecule is a glycine residue. In some embodiments, the linker is an alanine residue.

In one aspect, the intracellular signaling domain is designed to comprise the signaling domain of CD3-zeta and the signaling domain of CD28. In one aspect, the intracellular signaling domain is designed to comprise the signaling domain of CD3-zeta and the signaling domain of 4-1BB. In one aspect, the signaling domain of 4-1BB is a signaling domain of SEQ ID NO: 16. In one aspect, the signaling domain of CD3-zeta is a signaling domain of SEQ ID NO: 17.

In one aspect, the intracellular signaling domain is designed to comprise the signaling domain of CD3-zeta and the signaling domain of CD27. In one aspect, the signaling domain of CD27 comprises an amino acid sequence of QRRKYRSNKGESPVEPAEPCRYSCPREEEGSTIP-IQEDYRKPEPACSP (SEQ ID NO:51). In one aspect, the signalling domain of CD27 is encoded by a nucleic acid sequence of AGGAGTAAGAGGAGCAGGCTCCTG-CACAGTGACTACATGAACATGACTCCCCGCC GCCCCGGGCCCACCCGCAAGCATTACCAGCCCTAT-GCCCCACCACGCGACTTCGCA GCCTATCGCTCC (SEQ ID NO:52).

Natural Killer Cell Receptor (NKR) CARs

In an embodiment, a CAR molecule described herein comprises one or more components of a natural killer cell receptor (NKR), thereby forming an NKR-CAR. The NKR component can be a transmembrane domain, a hinge domain, or a cytoplasmic domain from any of the following natural killer cell receptors: killer cell immunoglobulin-like receptor (KIR), e.g., KIR2DL1, KIR2DL2/L3, KIR2DL4, KIR2DL5A, KIR2DL5B, KIR2DS1, KIR2DS2, KIR2DS3, KIR2DS4, DIR2DS5, KIR3DL1/S1, KIR3DL2, KIR3DL3, KIR2DP1, and KIR3DP1; natural cytotoxicity receptor (NCR), e.g., NKp30, NKp44, NKp46; signaling lymphocyte activation molecule (SLAM) family of immune cell receptors, e.g., CD48, CD229, 2B4, CD84, NTB-A, CRACC, BLAME, and CD2F-10; Fc receptor (FcR), e.g., CD16, and CD64; and Ly49 receptors, e.g., LY49A, LY49C. The NKR-CAR molecules described herein may interact with an adaptor molecule or intracellular signaling domain, e.g., DAP12. Exemplary configurations and sequences of CAR molecules comprising NKR components are described in International Publication No. WO2014/145252, the contents of which are hereby incorporated by reference.

Strategies for Regulating Chimeric Antigen Receptors

In some embodiments, a regulatable CAR (RCAR) where the CAR activity can be controlled is desirable to optimize the safety and efficacy of a CAR therapy. There are many ways CAR activities can be regulated. For example, inducing apoptosis using, e.g., a caspase fused to a dimerization domain (see, e.g., Di et al., N Engl. J. Med. 2011 Nov. 3; 365(18):1673-1683), can be used as a safety switch in the CAR therapy of the instant invention. In one embodiment, the cells (e.g., T cells or NK cells) expressing a CAR of the present invention further comprise an inducible apoptosis switch, wherein a human caspase (e.g., caspase 9) or a modified version is fused to a modification of the human FKB protein that allows conditional dimerization. In the presence of a small molecule, such as a rapalog (e.g., AP 1903, AP20187), the inducible caspase (e.g., caspase 9) is activated and leads to the rapid apoptosis and death of the cells (e.g., T cells or NK cells) expressing a CAR of the present invention. Examples of a caspase-based inducible apoptosis switch (or one or more aspects of such a switch) have been described in, e.g., US2004040047; US20110286980; US20140255360; WO1997031899; WO2014151960; WO2014164348; WO2014197638; WO2014197638; all of which are incorporated by reference herein.

In another example, CAR-expressing cells can also express an inducible Caspase-9 (iCaspase-9) molecule that, upon administration of a dimerizer drug (e.g., rimiducid (also called AP1903 (Bellicum Pharmaceuticals) or AP20187 (Ariad)) leads to activation of the Caspase-9 and apoptosis of the cells. The iCaspase-9 molecule contains a chemical inducer of dimerization (CID) binding domain that mediates dimerization in the presence of a CID. This results in inducible and selective depletion of CAR-expressing cells. In some cases, the iCaspase-9 molecule is encoded by a nucleic acid molecule separate from the CAR-encoding vector(s). In some cases, the iCaspase-9 molecule is encoded by the same nucleic acid molecule as the CAR-encoding vector. The iCaspase-9 can provide a safety switch to avoid any toxicity of CAR-expressing cells. See, e.g., Song et al. Cancer Gene Ther. 2008; 15(10):667-75; Clinical Trial Id. No. NCT02107963; and Di Stasi et al. N. Engl. J. Med. 2011; 365:1673-83.

Alternative strategies for regulating the CAR therapy of the instant invention include utilizing small molecules or antibodies that deactivate or turn off CAR activity, e.g., by deleting CAR-expressing cells, e.g., by inducing antibody dependent cell-mediated cytotoxicity (ADCC). For example, CAR-expressing cells described herein may also express an antigen that is recognized by molecules capable of inducing cell death, e.g., ADCC or complement-induced cell death. For example, CAR expressing cells described herein may also express a receptor capable of being targeted by an antibody or antibody fragment. Examples of such receptors include EpCAM, VEGFR, integrins (e.g., integrins αvβ3, α4, αI3/4β3, α4β7, α5β1, αvβ3, αv), members of the TNF receptor superfamily (e.g., TRAIL-R1, TRAIL-R2), PDGF Receptor, interferon receptor, folate receptor, GPNMB, ICAM-1, HLA-DR, CEA, CA-125, MUC1, TAG-72, IL-6 receptor, 5T4, GD2, GD3, CD2, CD3, CD4, CD5, CD11, CD11a/LFA-1, CD15, CD18/ITGB2, CD19, CD20, CD22, CD23/IgE Receptor, CD25, CD28, CD30, CD33, CD38, CD40, CD41, CD44, CD51, CD52, CD62L, CD74, CD80, CD125, CD147/basigin, CD152/CTLA-4, CD154/CD40L, CD195/CCR5, CD319/SLAMF7, and EGFR, and truncated versions thereof (e.g., versions preserving one or more extracellular epitopes but lacking one or more regions within the cytoplasmic domain).

For example, a CAR-expressing cell described herein may also express a truncated epidermal growth factor receptor (EGFR) which lacks signaling capacity but retains the epitope that is recognized by molecules capable of inducing ADCC, e.g., cetuximab (ERBITUX®), such that administration of cetuximab induces ADCC and subsequent depletion of the CAR-expressing cells (see, e.g., WO2011/056894, and Jonnalagadda et al., Gene Ther. 2013; 20(8) 853-860). Another strategy includes expressing a highly compact marker/suicide gene that combines target epitopes from both CD32 and CD20 antigens in the CAR-expressing cells described herein, which binds rituximab, resulting in selective depletion of the CAR-expressing cells, e.g., by ADCC (see, e.g., Philip et al., Blood. 2014; 124(8)1277-1287). Other methods for depleting CAR-expressing cells described herein include administration of CAMPATH, a monoclonal anti-CD52 antibody that selectively binds and targets mature lymphocytes, e.g., CAR-expressing cells, for destruction, e.g., by inducing ADCC. In other embodiments, the CAR-expressing cell can be selectively targeted using a CAR ligand, e.g., an anti-idiotypic antibody. In some embodiments, the anti-idiotypic antibody can cause effector cell activity, e.g., ADCC or ADC activities, thereby reducing the number of CAR-expressing cells. In other embodiments, the CAR ligand, e.g., the anti-idiotypic antibody, can be coupled to an agent that induces cell killing, e.g., a toxin, thereby reducing the number of CAR-expressing cells. Alternatively, the CAR molecules themselves can be configured such that the activity can be regulated, e.g., turned on and off, as described below.

In other embodiments, a CAR-expressing cell described herein may also express a target protein recognized by the T cell depleting agent. In one embodiment, the target protein is CD20 and the T cell depleting agent is an anti-CD20 antibody, e.g., rituximab. In such embodiment, the T cell depleting agent is administered once it is desirable to reduce or eliminate the CAR-expressing cell, e.g., to mitigate the CAR induced toxicity. In other embodiments, the T cell depleting agent is an anti-CD52 antibody, e.g., alemtuzumab.

In an aspect, a RCAR comprises a set of polypeptides, typically two in the simplest embodiments, in which the components of a standard CAR described herein, e.g., an antigen binding domain and an intracellular signaling domain, are partitioned on separate polypeptides or members. In some embodiments, the set of polypeptides include a dimerization switch that, upon the presence of a dimerization molecule, can couple the polypeptides to one another, e.g., can couple an antigen binding domain to an intracellular signaling domain. In one embodiment, a CAR of the present invention utilizes a dimerization switch as those described in, e.g., WO2014127261, which is incorporated by reference herein. Additional description and exemplary configurations of such regulatable CARs are provided herein and in International Publication No. WO 2015/090229, hereby incorporated by reference in its entirety.

In some embodiments, an RCAR involves a switch domain, e.g., a FKBP switch domain, as set out SEQ ID NO: 122, or comprise a fragment of FKBP having the ability to bind with FRB, e.g., as set out in SEQ ID NO: 123. In some embodiments, the RCAR involves a switch domain comprising a FRB sequence, e.g., as set out in SEQ ID NO: 124, or a mutant FRB sequence, e.g., as set out in any of SEQ ID Nos. 125-130.

(SEQ ID NO: 122)
D V P D Y A S L G G P S S P K K K R K V S R G <u>V Q</u>

<u>V E T I S P G D G R T F P K R G Q T C V V H Y T G</u>

<u>M L E D G K K F D S S R D R N K P F K F M L G K Q</u>

<u>E V I R G W E E G V A Q M S V G Q R A K L T I S P</u>

<u>D Y A Y G A T G H P G I I P P H A T L V F D V E L</u>

<u>L K L E T S</u> Y (SEQ ID NO: 123)
V Q V E T I S P G D G R T F P K R G Q T C V V H Y

T G M L E D G K K F D S S R D R N K P F K F M L G

K Q E V I R G W E E G V A Q M S V G Q R A K L T I

S P D Y A Y G A T G H P G I I P P H A T L V F D V

E L L K L E T S (SEQ ID NO: 124)
ILWHEMWHEG LEEASRLYFG ERNVKGMFEV LEPLHAMMER

GPQTLKETSF NQAYGRDLME AQEWCRKYMK SGNVKDLTQA

WDLYYHVFRR ISK

TABLE 1

Exemplary mutant FRB having increased affinity for a dimerization molecule.

| FRB mutant | Amino Acid Sequence | SEQ ID NO: |
|---|---|---|
| E2032I mutant | ILWHEMWHEGLIEASRLYFGERNVKGMFEVLEPLHAMMERGPQTLKETSFNQAYGRDLMEAQEWCRKYMKSGNVKDLTQAWDLYYHVFRRISKTS | 125 |
| E2032L mutant | ILWHEMWHEGLLEASRLYFGERNVKGMFEVLEPLHAMMERGPQTLKETSFNQAYGRDLMEAQEWCRKYMKSGNVKDLTQAWDLYYHVFRRISKTS | 126 |
| T2098L mutant | ILWHEMWHEGLEEASRLYFGERNVKGMFEVLEPLHAMMERGPQTLKETSFNQAYGRDLMEAQEWCRKYMKSGNVKDLLQAWDLYYHVFRRISKTS | 127 |
| E2032, T2098 mutant | ILWHEMWHEGL<u>X</u>EASRLYFGERNVKGMFEVLEPLHAMMERGPQTLKETSFNQAYGRDLMEAQEWCRKYMKSGNVKDL<u>X</u>QAWDLYYHVFRRISKTS | 128 |
| E2032I, T2098L mutant | ILWHEMWHEGLIEASRLYFGERNVKGMFEVLEPLHAMMERGPQTLKETSFNQAYGRDLMEAQEWCRKYMKSGNVKDLLQAWDLYYHVFRRISKTS | 129 |
| E2032L, T2098L mutant | ILWHEMWHEGLLEASRLYFGERNVKGMFEVLEPLHAMMERGPQTLKETSFNQAYGRDLMEAQEWCRKYMKSGNVKDLLQAWDLYYHVFRRISKTS | 130 |

Split CAR

In some embodiments, the CAR-expressing cell uses a split CAR. The split CAR approach is described in more detail in publications WO2014/055442 and WO2014/055657. Briefly, a split CAR system comprises a cell expressing a first CAR having a first antigen binding domain and a costimulatory domain (e.g., 41BB), and the cell also expresses a second CAR having a second antigen binding domain and an intracellular signaling domain (e.g., CD3 zeta). When the cell encounters the first antigen, the costimulatory domain is activated, and the cell proliferates. When the cell encounters the second antigen, the intracellular signaling domain is activated and cell-killing activity begins. Thus, the CAR-expressing cell is only fully activated in the presence of both antigens.

RNA Transfection

Disclosed herein are methods for producing an in vitro transcribed RNA CAR. The present invention also includes (among other things) a CAR encoding RNA construct that can be directly transfected into a cell. A method for generating mRNA for use in transfection can involve in vitro transcription (IVT) of a template with specially designed primers, followed by polyA addition, to produce a construct containing 3' and 5' untranslated sequence ("UTR"), a 5' cap and/or Internal Ribosome Entry Site (IRES), the nucleic acid to be expressed, and a polyA tail, typically 50-2000 bases in length (SEQ ID NO:118). RNA so produced can efficiently transfect different kinds of cells. In one aspect, the template includes sequences for the CAR.

In one aspect the CAR is encoded by a messenger RNA (mRNA). In one aspect the mRNA encoding the CAR is introduced into an immune effector cell, e.g., a T cell or a NK cell, for production of a CAR-expressing cell, e.g., a CART cell or a CAR NK cell.

In one embodiment, the in vitro transcribed RNA CAR can be introduced to a cell as a form of transient transfection. The RNA is produced by in vitro transcription using a polymerase chain reaction (PCR)-generated template. DNA of interest from any source can be directly converted by PCR into a template for in vitro mRNA synthesis using appropriate primers and RNA polymerase. The source of the DNA can be, for example, genomic DNA, plasmid DNA, phage DNA, cDNA, synthetic DNA sequence or any other appropriate source of DNA. A desired temple for in vitro transcription is a CAR of the present invention. For example, the template for the RNA CAR comprises an extracellular region comprising a single chain variable domain of an anti-tumor antibody; a hinge region, a transmembrane domain (e.g., a transmembrane domain of CD8a); and a cytoplasmic region that includes an intracellular signaling domain, e.g., comprising the signaling domain of CD3-zeta and the signaling domain of 4-1BB.

In one embodiment, the DNA to be used for PCR contains an open reading frame. The DNA can be from a naturally occurring DNA sequence from the genome of an organism. In one embodiment, the nucleic acid can include some or all of the 5' and/or 3' untranslated regions (UTRs). The nucleic acid can include exons and introns. In one embodiment, the DNA to be used for PCR is a human nucleic acid sequence. In another embodiment, the DNA to be used for PCR is a human nucleic acid sequence including the 5' and 3' UTRs. The DNA can alternatively be an artificial DNA sequence that is not normally expressed in a naturally occurring organism. An exemplary artificial DNA sequence is one that contains portions of genes that are ligated together to form an open reading frame that encodes a fusion protein. The portions of DNA that are ligated together can be from a single organism or from more than one organism.

PCR is used to generate a template for in vitro transcription of mRNA which is used for transfection. Methods for performing PCR are well known in the art. Primers for use in PCR are designed to have regions that are substantially complementary to regions of the DNA to be used as a template for the PCR. "Substantially complementary," as used herein, refers to sequences of nucleotides where a majority or all of the bases in the primer sequence are complementary, or one or more bases are non-complementary, or mismatched. Substantially complementary sequences are able to anneal or hybridize with the intended DNA target under annealing conditions used for PCR. The primers can be designed to be substantially complementary to any portion of the DNA template. For example, the primers can be designed to amplify the portion of a nucleic acid that is normally transcribed in cells (the open reading frame), including 5' and 3' UTRs. The primers can also be designed to amplify a portion of a nucleic acid that encodes a particular domain of interest. In one embodiment, the primers are designed to amplify the coding region of a human cDNA, including all or portions of the 5' and 3' UTRs. Primers useful for PCR can be generated by synthetic methods that are well known in the art. "Forward primers" are primers that contain a region of nucleotides that are substantially complementary to nucleotides on the DNA template that are upstream of the DNA sequence that is to be amplified. "Upstream" is used herein to refer to a location 5, to the DNA sequence to be amplified relative to the coding strand. "Reverse primers" are primers that contain a region of nucleotides that are substantially complementary to a double-stranded DNA template that are downstream of the DNA sequence that is to be amplified. "Downstream" is used herein to refer to a location 3' to the DNA sequence to be amplified relative to the coding strand.

Any DNA polymerase useful for PCR can be used in the methods disclosed herein. The reagents and polymerase are commercially available from a number of sources.

Chemical structures with the ability to promote stability and/or translation efficiency may also be used. The RNA in some embodiments has 5' and 3' UTRs. In one embodiment, the 5' UTR is between one and 3000 nucleotides in length. The length of 5' and 3' UTR sequences to be added to the coding region can be altered by different methods, including, but not limited to, designing primers for PCR that anneal to different regions of the UTRs. Using this approach, one of ordinary skill in the art can modify the 5' and 3' UTR lengths required to achieve optimal translation efficiency following transfection of the transcribed RNA.

The 5' and 3' UTRs can be the naturally occurring, endogenous 5' and 3' UTRs for the nucleic acid of interest. Alternatively, UTR sequences that are not endogenous to the nucleic acid of interest can be added by incorporating the UTR sequences into the forward and reverse primers or by any other modifications of the template. The use of UTR sequences that are not endogenous to the nucleic acid of interest can be useful for modifying the stability and/or translation efficiency of the RNA. For example, it is known that AU-rich elements in 3' UTR sequences can decrease the stability of mRNA. Therefore, 3' UTRs can be selected or designed to increase the stability of the transcribed RNA based on properties of UTRs that are well known in the art.

In one embodiment, the 5' UTR can contain the Kozak sequence of the endogenous nucleic acid. Alternatively, when a 5' UTR that is not endogenous to the nucleic acid of interest is being added by PCR as described above, a consensus Kozak sequence can be redesigned by adding the 5' UTR sequence. Kozak sequences can increase the efficiency of translation of some RNA transcripts, but does not appear to be required for all RNAs to enable efficient translation. The requirement for Kozak sequences for many mRNAs is known in the art. In other embodiments the 5' UTR can be 5'UTR of an RNA virus whose RNA genome is stable in cells. In other embodiments various nucleotide analogues can be used in the 3' or 5' UTR to impede exonuclease degradation of the mRNA.

To enable synthesis of RNA from a DNA template without the need for gene cloning, a promoter of transcription should be attached to the DNA template upstream of the sequence to be transcribed. When a sequence that functions as a promoter for an RNA polymerase is added to the 5' end of the forward primer, the RNA polymerase promoter becomes incorporated into the PCR product upstream of the open reading frame that is to be transcribed. In one embodiment, the promoter is a T7 polymerase promoter, as described elsewhere herein. Other useful promoters include, but are not limited to, T3 and SP6 RNA polymerase promoters. Consensus nucleotide sequences for T7, T3 and SP6 promoters are known in the art.

In an embodiment, the mRNA has both a cap on the 5' end and a 3' poly(A) tail which determine ribosome binding, initiation of translation and stability mRNA in the cell. On a circular DNA template, for instance, plasmid DNA, RNA polymerase produces a long concatameric product which is not suitable for expression in eukaryotic cells. The transcription of plasmid DNA linearized at the end of the 3' UTR results in normal sized mRNA which is not effective in eukaryotic transfection even if it is polyadenylated after transcription.

On a linear DNA template, phage T7 RNA polymerase can extend the 3' end of the transcript beyond the last base of the template (Schenborn and Mierendorf, Nuc Acids Res., 13:6223-36 (1985); Nacheva and Berzal-Herranz, Eur. J. Biochem., 270:1485-65 (2003).

The conventional method of integration of polyA/T stretches into a DNA template is molecular cloning. However polyA/T sequence integrated into plasmid DNA can cause plasmid instability, which is why plasmid DNA templates obtained from bacterial cells are often highly contaminated with deletions and other aberrations. This makes cloning procedures not only laborious and time consuming but often not reliable. That is why a method which allows construction of DNA templates with polyA/T 3' stretch without cloning highly desirable.

The polyA/T segment of the transcriptional DNA template can be produced during PCR by using a reverse primer containing a polyT tail, such as 100T tail (SEQ ID NO: 29) (size can be 50-5000 T (SEQ ID NO: 30)), or after PCR by any other method, including, but not limited to, DNA ligation or in vitro recombination. Poly(A) tails also provide stability to RNAs and reduce their degradation. Generally, the length of a poly(A) tail positively correlates with the stability of the transcribed RNA. In one embodiment, the poly(A) tail is between 100 and 5000 adenosines (SEQ ID NO: 57).

Poly(A) tails of RNAs can be further extended following in vitro transcription with the use of a poly(A) polymerase, such as E. coli polyA polymerase (E-PAP). In one embodiment, increasing the length of a poly(A) tail from 100 nucleotides to between 300 and 400 nucleotides (SEQ ID NO: 104) results in about a two-fold increase in the translation efficiency of the RNA. Additionally, the attachment of different chemical groups to the 3' end can increase mRNA stability. Such attachment can contain modified/artificial nucleotides, aptamers and other compounds. For example, ATP analogs can be incorporated into the poly(A) tail using poly(A) polymerase. ATP analogs can further increase the stability of the RNA.

5' caps on also provide stability to RNA molecules. In an embodiment, RNAs produced by the methods disclosed herein include a 5' cap. The 5' cap is provided using techniques known in the art and described herein (Cougot, et al., Trends in Biochem. Sci., 29:436-444 (2001); Stepinski, et al., RNA, 7:1468-95 (2001); Elango, et al., Biochim. Biophys. Res. Commun., 330:958-966 (2005)).

The RNAs produced by the methods disclosed herein can also contain an internal ribosome entry site (IRES) sequence. The IRES sequence may be any viral, chromosomal or artificially designed sequence which initiates cap-independent ribosome binding to mRNA and facilitates the initiation of translation. Any solutes suitable for cell electroporation, which can contain factors facilitating cellular permeability and viability such as sugars, peptides, lipids, proteins, antioxidants, and surfactants can be included.

RNA can be introduced into target cells using any of a number of different methods, for instance, commercially available methods which include, but are not limited to, electroporation (Amaxa Nucleofector-II (Amaxa Biosystems, Cologne, Germany)), (ECM 830 (BTX) (Harvard Instruments, Boston, Mass.) or the Gene Pulser II (BioRad, Denver, Colo.), Multiporator (Eppendort, Hamburg Germany), cationic liposome mediated transfection using lipofection, polymer encapsulation, peptide mediated transfection, or biolistic particle delivery systems such as "gene guns" (see, for example, Nishikawa, et al. Hum Gene Ther., 12(8):861-70 (2001).

Non-Viral Delivery Methods

In some aspects, non-viral methods can be used to deliver a nucleic acid encoding a CAR described herein into a cell or tissue or a subject.

In some embodiments, the non-viral method includes the use of a transposon (also called a transposable element). In some embodiments, a transposon is a piece of DNA that can insert itself at a location in a genome, for example, a piece of DNA that is capable of self-replicating and inserting its copy into a genome, or a piece of DNA that can be spliced out of a longer nucleic acid and inserted into another place in a genome. For example, a transposon comprises a DNA sequence made up of inverted repeats flanking genes for transposition.

Exemplary methods of nucleic acid delivery using a transposon include a Sleeping Beauty transposon system (SBTS) and a piggyBac (PB) transposon system. See, e.g., Aronovich et al. Hum. Mol. Genet. 20.R1(2011):R14-20; Singh et al. Cancer Res. 15(2008):2961-2971; Huang et al. Mol. Ther. 16(2008):580-589; Grabundzija et al. Mol. Ther. 18(2010):1200-1209; Kebriaei et al. Blood. 122.21(2013): 166; Williams. Molecular Therapy 16.9(2008):1515-16; Bell et al. Nat. Protoc. 2.12(2007):3153-65; and Ding et al. Cell. 122.3(2005):473-83, all of which are incorporated herein by reference.

The SBTS includes two components: 1) a transposon containing a transgene and 2) a source of transposase enzyme. The transposase can transpose the transposon from a carrier plasmid (or other donor DNA) to a target DNA, such as a host cell chromosome/genome. For example, the transposase binds to the carrier plasmid/donor DNA, cuts the transposon (including transgene(s)) out of the plasmid, and inserts it into the genome of the host cell. See, e.g., Aronovich et al.

Exemplary transposons include a pT2-based transposon. See, e.g., Grabundzija et al. Nucleic Acids Res. 41.3(2013): 1829-47; and Singh et al. Cancer Res. 68.8(2008): 2961-2971, all of which are incorporated herein by reference. Exemplary transposases include a Tc1/mariner-type transposase, e.g., the SB10 transposase or the SB11 transposase (a hyperactive transposase which can be expressed, e.g., from a cytomegalovirus promoter). See, e.g., Aronovich et al.; Kebriaei et al.; and Grabundzija et al., all of which are incorporated herein by reference.

Use of the SBTS permits efficient integration and expression of a transgene, e.g., a nucleic acid encoding a CAR described herein. Provided herein are methods of generating a cell, e.g., T cell or NK cell, that stably expresses a CAR described herein, e.g., using a transposon system such as SBTS.

In accordance with methods described herein, in some embodiments, one or more nucleic acids, e.g., plasmids, containing the SBTS components are delivered to a cell (e.g., T or NK cell). For example, the nucleic acid(s) are delivered by standard methods of nucleic acid (e.g., plasmid DNA) delivery, e.g., methods described herein, e.g., electroporation, transfection, or lipofection. In some embodiments, the nucleic acid contains a transposon comprising a transgene, e.g., a nucleic acid encoding a CAR described herein. In some embodiments, the nucleic acid contains a transposon comprising a transgene (e.g., a nucleic acid encoding a CAR described herein) as well as a nucleic acid sequence encoding a transposase enzyme. In other embodiments, a system with two nucleic acids is provided, e.g., a dual-plasmid system, e.g., where a first plasmid contains a transposon comprising a transgene, and a second plasmid contains a nucleic acid sequence encoding a transposase enzyme. For example, the first and the second nucleic acids are co-delivered into a host cell.

In some embodiments, cells, e.g., T or NK cells, are generated that express a CAR described herein by using a combination of gene insertion using the SBTS and genetic editing using a nuclease (e.g., Zinc finger nucleases (ZFNs), Transcription Activator-Like Effector Nucleases (TALENs), the CRISPR/Cas system, or engineered meganuclease re-engineered homing endonucleases).

In some embodiments, use of a non-viral method of delivery permits reprogramming of cells, e.g., T or NK cells, and direct infusion of the cells into a subject. Advantages of non-viral vectors include but are not limited to the ease and relatively low cost of producing sufficient amounts required to meet a patient population, stability during storage, and lack of immunogenicity.

Nucleic Acid Constructs Encoding a CAR, e.g., a CD19 CAR, CD20 CAR, or CD22 CAR

The present invention also provides nucleic acid molecules encoding one or more CAR constructs described herein, e.g., CD19 CAR, CD20 CAR, or CD22 CAR. In one aspect, the nucleic acid molecule is provided as a messenger RNA transcript. In one aspect, the nucleic acid molecule is provided as a DNA construct.

Accordingly, in one aspect, the invention pertains to an isolated nucleic acid molecule encoding a chimeric antigen receptor (CAR), wherein the CAR comprises a binding domain (e.g., that binds CD19, CD20, or CD22) a transmembrane domain, and an intracellular signaling domain comprising a stimulatory domain, e.g., a costimulatory signaling domain and/or a primary signaling domain, e.g., zeta chain.

In one embodiment, the binding domain is an anti-CD19 binding domain described herein, e.g., an anti-CD19 binding domain which comprises a sequence selected from a group consisting of SEQ ID NO:1, SEQ ID NO:2, SEQ ID NO:3, SEQ ID NO:4, SEQ ID NO:5, SEQ ID NO:6, SEQ ID NO:7, SEQ ID NO:8, SEQ ID NO:9, SEQ ID NO:10, SEQ ID NO:11, SEQ ID NO:12 and SEQ ID NO:59, or a sequence with 95-99% identity thereof.

In one embodiment, the nucleic acid comprises CD22-encoding a nucleic acid set out in Table 6A or a sequence with 95-99% identity thereof. In one embodiment, the nucleic acid is a nucleic acid encoding an amino acid sequence set out in any of Tables 6A-10B or a sequence with 95-99% identity thereof.

In one embodiment, the nucleic acid comprises CD20-encoding a nucleic acid set out in Table 11A or a sequence with 95-99% identity thereof. In one embodiment, the nucleic acid is a nucleic acid encoding an amino acid sequence set out in any of Tables 11A-15B or a sequence with 95-99% identity thereof.

In one embodiment, the transmembrane domain is transmembrane domain of a protein selected from the group consisting of the alpha, beta or zeta chain of the T-cell receptor, CD28, CD3 epsilon, CD45, CD4, CDS, CD8, CD9, CD16, CD22, CD33, CD37, CD64, CD80, CD86, CD134, CD137 and CD154. In one embodiment, the transmembrane domain comprises a sequence of SEQ ID NO: 15, or a sequence with 95-99% identity thereof. In one embodiment, the anti-CD19 binding domain is connected to the transmembrane domain by a hinge region, e.g., a hinge described herein. In one embodiment, the hinge region comprises SEQ ID NO:14 or SEQ ID NO:45 or SEQ ID NO:47 or SEQ ID NO:49, or a sequence with 95-99% identity thereof. In one embodiment, the isolated nucleic acid molecule further comprises a sequence encoding a costimulatory domain. In one embodiment, the costimulatory domain is a functional signaling domain of a protein selected from the group consisting of OX40, CD27, CD28, CDS, ICAM-1, LFA-1 (CD11a/CD18), ICOS (CD278), and 4-1BB (CD137). In one embodiment, the costimulatory domain is a functional signaling domain of a protein selected from the group consisting of MHC class I molecule, TNF receptor proteins, Immunoglobulin-like proteins, cytokine receptors, integrins, signaling lymphocytic activation molecules (SLAM proteins), activating NK cell receptors, BTLA, a Toll ligand receptor, OX40, CD2, CD7, CD27, CD28, CD30, CD40, CDS, ICAM-1, LFA-1 (CD11a/CD18), 4-1BB (CD137), B7-H3, CDS, ICAM-1, ICOS (CD278), GITR, BAFFR, LIGHT, HVEM (LIGHTR), KIRDS2, SLAMF7, NKp80 (KLRF1), NKp44, NKp30, NKp46, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, CD19a, and a ligand that specifically binds with CD83. In one embodiment, the costimulatory domain comprises a sequence of SEQ ID NO:16, or a sequence with 95-99% identity thereof. In one embodiment, the intracellular signaling domain comprises a functional signaling domain of 4-1BB and a functional signaling domain of CD3 zeta. In one embodiment, the intracellular signaling domain comprises the sequence of SEQ ID NO: 16 or SEQ ID NO:51, or a sequence with 95-99% identity thereof, and the sequence of SEQ ID NO: 17 or SEQ ID NO:43, or a sequence with 95-99% identity thereof, wherein the sequences comprising the intracellular signaling domain are expressed in the same frame and as a single polypeptide chain.

In another aspect, the invention pertains to an isolated nucleic acid molecule encoding a CAR construct comprising a leader sequence of SEQ ID NO: 13, a scFv domain having a sequence selected from the group consisting of SEQ ID NO:1, SEQ ID NO:2, SEQ ID NO:3, SEQ ID NO:4, SEQ ID NO:5, SEQ ID NO:6, SEQ ID NO:7, SEQ ID NO:8, SEQ ID NO:9, SEQ ID NO:10, SEQ ID NO:11, SEQ ID NO:12, and SEQ ID NO:59, (or a sequence with 95-99% identity thereof), a hinge region of SEQ ID NO:14 or SEQ ID NO:45 or SEQ ID NO:47 or SEQ ID NO:49 (or a sequence with 95-99% identity thereof), a transmembrane domain having a sequence of SEQ ID NO: 15 (or a sequence with 95-99% identity thereof), a 4-1BB costimulatory domain having a sequence of SEQ ID NO:16 or a CD27 costimulatory domain having a sequence of SEQ ID NO:51 (or a sequence with 95-99% identity thereof), and a CD3 zeta stimulatory domain having a sequence of SEQ ID NO:17 or SEQ ID NO:43 (or a sequence with 95-99% identity thereof).

In another aspect, the invention pertains to an isolated polypeptide molecule encoded by the nucleic acid molecule. In one embodiment, the isolated polypeptide molecule comprises a sequence selected from the group consisting of SEQ ID NO:31, SEQ ID NO:32, SEQ ID NO:33, SEQ ID NO:34, SEQ ID NO:35, SEQ ID NO:36, SEQ ID NO:37, SEQ ID NO:38, SEQ ID NO:39, SEQ ID NO:40, SEQ ID NO:41, SEQ ID NO:42, SEQ ID NO:59 or a sequence with 95-99% identity thereof.

In another aspect, the invention pertains to a nucleic acid molecule encoding a chimeric antigen receptor (CAR) molecule that comprises an anti-CD19 binding domain, a transmembrane domain, and an intracellular signaling domain comprising a stimulatory domain, and wherein said anti-CD19 binding domain comprises a sequence selected from the group consisting of SEQ ID NO:1, SEQ ID NO:2, SEQ ID NO:3, SEQ ID NO:4, SEQ ID NO:5, SEQ ID NO:6, SEQ ID NO:7, SEQ ID NO:8, SEQ ID NO:9, SEQ ID NO:10, SEQ ID NO:11, SEQ ID NO:12 and SEQ ID NO:59, or a sequence with 95-99% identity thereof.

In one embodiment, the encoded CAR molecule (e.g., CD19 CAR, CD20 CAR, or CD22 CAR) further comprises a sequence encoding a costimulatory domain. In one embodiment, the costimulatory domain is a functional signaling domain of a protein selected from the group consisting of OX40, CD27, CD28, CDS, ICAM-1, LFA-1 (CD11a/CD18) and 4-1BB (CD137). In one embodiment, the costimulatory domain comprises a sequence of SEQ ID NO:16. In one embodiment, the transmembrane domain is a transmembrane domain of a protein selected from the group consisting of the alpha, beta or zeta chain of the T-cell receptor, CD28, CD3 epsilon, CD45, CD4, CD5, CD8, CD9, CD16, CD22, CD33, CD37, CD64, CD80, CD86, CD134, CD137 and CD154. In one embodiment, the transmembrane domain comprises a sequence of SEQ ID NO:15. In one embodiment, the intracellular signaling domain comprises a functional signaling domain of 4-1BB and a functional signaling domain of zeta. In one embodiment, the intracellular signaling domain comprises the sequence of SEQ ID NO: 16 and the sequence of SEQ ID NO: 17, wherein the sequences comprising the intracellular signaling domain are expressed in the same frame and as a single polypeptide chain. In one embodiment, the anti-CD19 binding domain is connected to the transmembrane domain by a hinge region. In one embodiment, the hinge region comprises SEQ ID NO:14. In one embodiment, the hinge region comprises SEQ ID NO:45 or SEQ ID NO:47 or SEQ ID NO:49.

In another aspect, the invention pertains to an encoded CAR molecule comprising a leader sequence of SEQ ID NO: 13, a scFv having a sequence selected from the group consisting of SEQ ID NO:1, SEQ ID NO:2, SEQ ID NO:3, SEQ ID NO:4, SEQ ID NO:5, SEQ ID NO:6, SEQ ID NO:7, SEQ ID NO:8, SEQ ID NO:9, SEQ ID NO:10, SEQ ID NO:11, SEQ ID NO:12, and SEQ ID NO:59, or a sequence with 95-99% identity thereof, a hinge region of SEQ ID NO:14 or SEQ ID NO:45 or SEQ ID NO:47 or SEQ ID NO:49, a transmembrane domain having a sequence of SEQ ID NO: 15, a 4-1BB costimulatory domain having a sequence of SEQ ID NO:16 or a CD27 costimulatory domain having a sequence of SEQ ID NO:51, and a CD3 zeta stimulatory domain having a sequence of SEQ ID NO:17 or SEQ ID NO:43. In one embodiment, the encoded CAR molecule comprises a sequence selected from a group consisting of SEQ ID NO:31, SEQ ID NO:32, SEQ ID NO:33, SEQ ID NO:34, SEQ ID NO:35, SEQ ID NO:36, SEQ ID NO:37, SEQ ID NO:38, SEQ ID NO:39, SEQ ID NO:40, SEQ ID NO:41, SEQ ID NO:42, and SEQ ID NO:59, or a sequence with 95-99% identity thereof.

The nucleic acid sequences coding for the desired molecules can be obtained using recombinant methods known in the art, such as, for example by screening libraries from cells expressing the gene, by deriving the gene from a vector known to include the same, or by isolating directly from cells and tissues containing the same, using standard techniques. Alternatively, the gene of interest can be produced synthetically, rather than cloned.

The present invention also provides vectors in which a DNA of the present invention is inserted. Vectors derived from retroviruses such as the lentivirus are suitable tools to achieve long-term gene transfer since they allow long-term, stable integration of a transgene and its propagation in daughter cells. Lentiviral vectors have the added advantage over vectors derived from onco-retroviruses such as murine leukemia viruses in that they can transduce non-proliferating cells, such as hepatocytes. They also have the added advantage of low immunogenicity. A retroviral vector may also be, e.g., a gammaretroviral vector. A gammaretroviral vector may include, e.g., a promoter, a packaging signal (w), a primer binding site (PBS), one or more (e.g., two) long terminal repeats (LTR), and a transgene of interest, e.g., a gene encoding a CAR. A gammaretroviral vector may lack viral structural gens such as gag, pol, and env. Exemplary gammaretroviral vectors include Murine Leukemia Virus (MLV), Spleen-Focus Forming Virus (SFFV), and Myeloproliferative Sarcoma Virus (MPSV), and vectors derived therefrom. Other gammaretroviral vectors are described, e.g., in Tobias Maetzig et al., "Gammaretroviral Vectors: Biology, Technology and Application" Viruses. 2011 June; 3(6): 677-713.

In another embodiment, the vector comprising the nucleic acid encoding the desired CAR of the invention is an adenoviral vector (A5/35). In another embodiment, the expression of nucleic acids encoding CARs can be accomplished using of transposons such as sleeping beauty, crispr, CAS9, and zinc finger nucleases. See below June et al. 2009 Nature Reviews Immunology 9.10: 704-716, is incorporated herein by reference.

A vector may also include, e.g., a signal sequence to facilitate secretion, a polyadenylation signal and transcription terminator (e.g., from Bovine Growth Hormone (BGH) gene), an element allowing episomal replication and replication in prokaryotes (e.g. SV40 origin and ColE1 or others known in the art) and/or elements to allow selection (e.g., ampicillin resistance gene and/or zeocin marker).

In brief summary, the expression of natural or synthetic nucleic acids encoding CARs is typically achieved by operably linking a nucleic acid encoding the CAR polypeptide or portions thereof to a promoter, and incorporating the construct into an expression vector. The vectors can be suitable for replication and integration eukaryotes. Typical cloning vectors contain transcription and translation terminators, initiation sequences, and promoters useful for regulation of the expression of the desired nucleic acid sequence.

In some aspects, the expression constructs of the present invention may also be used for nucleic acid immunization and gene therapy, using standard gene delivery protocols. Methods for gene delivery are known in the art. See, e.g., U.S. Pat. Nos. 5,399,346, 5,580,859, 5,589,466, incorporated by reference herein in their entireties. In another embodiment, the invention provides a gene therapy vector.

The nucleic acid can be cloned into a number of types of vectors. For example, the nucleic acid can be cloned into a vector including, but not limited to a plasmid, a phagemid, a phage derivative, an animal virus, and a cosmid. Vectors of particular interest include expression vectors, replication vectors, probe generation vectors, and sequencing vectors.

Further, the expression vector may be provided to a cell in the form of a viral vector. Viral vector technology is well known in the art and is described, for example, in Sambrook et al., 2012, MOLECULAR CLONING: A LABORATORY MANUAL, volumes 1-4, Cold Spring Harbor Press, NY), and in other virology and molecular biology manuals. Viruses, which are useful as vectors include, but are not limited to, retroviruses, adenoviruses, adeno-associated viruses, herpes viruses, and lentiviruses. In general, a suitable vector contains an origin of replication functional in at least one organism, a promoter sequence, convenient restriction endonuclease sites, and one or more selectable markers, (e.g., WO 01/96584; WO 01/29058; and U.S. Pat. No. 6,326,193).

A number of viral based systems have been developed for gene transfer into mammalian cells. For example, retroviruses provide a convenient platform for gene delivery systems. A selected gene can be inserted into a vector and packaged in retroviral particles using techniques known in the art. The recombinant virus can then be isolated and delivered to cells of the subject either in vivo or ex vivo. A number of retroviral systems are known in the art. In some embodiments, adenovirus vectors are used. A number of adenovirus vectors are known in the art. In one embodiment, lentivirus vectors are used.

Additional promoter elements, e.g., enhancers, regulate the frequency of transcriptional initiation. Typically, these are located in the region 30-110 bp upstream of the start site, although a number of promoters have been shown to contain functional elements downstream of the start site as well. The spacing between promoter elements frequently is flexible, so that promoter function is preserved when elements are inverted or moved relative to one another. In the thymidine kinase (tk) promoter, the spacing between promoter elements can be increased to 50 bp apart before activity begins to decline. Depending on the promoter, it appears that individual elements can function either cooperatively or independently to activate transcription. Exemplary promoters include the CMV IE gene, EF-1α, ubiquitin C, or phosphoglycerokinase (PGK) promoters. In an embodiment, the promoter is a PGK promoter, e.g., a truncated PGK promoter as described herein.

An example of a promoter that is capable of expressing a CAR transgene in a mammalian T cell is the EF1a promoter. The native EF1a promoter drives expression of the alpha subunit of the elongation factor-1 complex, which is responsible for the enzymatic delivery of aminoacyl tRNAs to the ribosome. The EF1a promoter has been extensively used in mammalian expression plasmids and has been shown to be effective in driving CAR expression from transgenes cloned into a lentiviral vector. See, e.g., Milone et al., Mol. Ther. 17(8): 1453-1464 (2009). In one aspect, the EF1a promoter comprises the sequence provided as SEQ ID NO:100.

Another example of a promoter is the immediate early cytomegalovirus (CMV) promoter sequence. This promoter sequence is a strong constitutive promoter sequence capable of driving high levels of expression of any polynucleotide sequence operatively linked thereto. However, other constitutive promoter sequences may also be used, including, but not limited to the simian virus 40 (SV40) early promoter, mouse mammary tumor virus (MMTV), human immunodeficiency virus (HIV) long terminal repeat (LTR) promoter, MoMuLV promoter, an avian leukemia virus promoter, an Epstein-Barr virus immediate early promoter, a Rous sarcoma virus promoter, as well as human gene promoters such as, but not limited to, the actin promoter, the myosin promoter, the elongation factor-1α promoter, the hemoglobin promoter, and the creatine kinase promoter. Further, the invention should not be limited to the use of constitutive promoters. Inducible promoters are also contemplated as part of the invention. The use of an inducible promoter provides a molecular switch capable of turning on expression of the polynucleotide sequence which it is operatively linked when such expression is desired, or turning off the expression when expression is not desired. Examples of inducible promoters include, but are not limited to a metallothionine promoter, a glucocorticoid promoter, a progesterone promoter, and a tetracycline promoter.

Another example of a promoter is the phosphoglycerate kinase (PGK) promoter. In embodiments, a truncated PGK promoter (e.g., a PGK promoter with one or more, e.g., 1, 2, 5, 10, 100, 200, 300, or 400, nucleotide deletions when compared to the wild-type PGK promoter sequence) may be desired. The nucleotide sequences of exemplary PGK promoters are provided below.

WT PGK Promoter:

(SEQ ID NO: 1323)
ACCCCTCTCTCCAGCCACTAAGCCAGTTGCTCCCTCGGCTGACGGCTGCA

CGCGAGGCCTCCGAACGTCTTACGCCTTGTGGCGCGCCCGTCCTTGTCCC

GGGTGTGATGGCGGGGTGTGGGCGGAGGGCGTGGCGGGGAAGGGCCGGC

GACGAGAGCCGCGCGGGACGACTCGTCGGCGATAACCGGTGTCGGGTAGC

GCCAGCCGCGCGACGGTAACGAGGGACCGCGACAGGCAGACGCTCCCATG

ATCACTCTGCACGCCGAAGGCAAATAGTGCAGGCCGTGCGGCGCTTGGCG

TTCCTTGGAAGGGCTGAATCCCCGCCTCGTCCTTCGCAGCGGCCCCCCGG

GTGTTCCCATCGCCGCTTCTAGGCCCACTGCGACGCTTGCCTGCACTTCT

TACACGCTCTGGGTCCCAGCCGCGGCGACGCAAAGGGCCTTGGTGCGGGT

CTCGTCGGCGCAGGGACGCGTTTGGGTCCCGACGGAACCTTTTCCGCGTT

GGGGTTGGGGCACCATAAGCT

Exemplary Truncated PGK Promoters:

PGK100:
(SEQ ID NO: 1324)
ACCCCTCTCTCCAGCCACTAAGCCAGTTGCTCCCTCGGCTGACGGCTGCA

CGCGAGGCCTCCGAACGTCTTACGCCTTGTGGCGCGCCCGTCCTTGTCCC

GGGTGTGATGGCGGGGTG

PGK200:
(SEQ ID NO: 1325)
ACCCCTCTCTCCAGCCACTAAGCCAGTTGCTCCCTCGGCTGACGGCTGCA

CGCGAGGCCTCCGAACGTCTTACGCCTTGTGGCGCGCCCGTCCTTGTCCC

GGGTGTGATGGCGGGGTGTGGGGCGGAGGGCGTGGCGGGGAAGGGCCGGC

GACGAGAGCCGCGCGGGACGACTCGTCGGCGATAACCGGTGTCGGGTAGC

GCCAGCCGCGCGACGGTAACG

PGK300:
(SEQ ID NO: 1326)
ACCCCTCTCTCCAGCCACTAAGCCAGTTGCTCCCTCGGCTGACGGCTGCA

CGCGAGGCCTCCGAACGTCTTACGCCTTGTGGCGCGCCCGTCCTTGTCCC

GGGTGTGATGGCGGGGTGTGGGGCGGAGGGCGTGGCGGGGAAGGGCCGGC

GACGAGAGCCGCGCGGGACGACTCGTCGGCGATAACCGGTGTCGGGTAGC

GCCAGCCGCGCGACGGTAACGAGGGACCGCGACAGGCAGACGCTCCCATG

ATCACTCTGCACGCCGAAGGCAAATAGTGCAGGCCGTGCGGCGCTTGGCG

TTCCTTGGAAGGGCTGAATCCCCG

PGK400:
(SEQ ID NO: 1327)
ACCCCTCTCTCCAGCCACTAAGCCAGTTGCTCCCTCGGCTGACGGCTGCA

CGCGAGGCCTCCGAACGTCTTACGCCTTGTGGCGCGCCCGTCCTTGTCCC

GGGTGTGATGGCGGGGTGTGGGGCGGAGGGCGTGGCGGGGAAGGGCCGGC

GACGAGAGCCGCGCGGGACGACTCGTCGGCGATAACCGGTGTCGGGTAGC

GCCAGCCGCGCGACGGTAACGAGGGACCGCGACAGGCAGACGCTCCCATG

ATCACTCTGCACGCCGAAGGCAAATAGTGCAGGCCGTGCGGCGCTTGGCG

TTCCTTGGAAGGGCTGAATCCCCGCCTCGTCCTTCGCAGCGGCCCCCGG

GTGTTCCCATCGCCGCTTCTAGGCCCACTGCGACGCTTGCCTGCACTTCT

TACACGCTCTGGGTCCCAGCCG

A vector may also include, e.g., a signal sequence to facilitate secretion, a polyadenylation signal and transcription terminator (e.g., from Bovine Growth Hormone (BGH) gene), an element allowing episomal replication and replication in prokaryotes (e.g. SV40 origin and ColE1 or others known in the art) and/or elements to allow selection (e.g., ampicillin resistance gene and/or zeocin marker).

In order to assess the expression of a CAR polypeptide or portions thereof, the expression vector to be introduced into a cell can also contain either a selectable marker gene or a reporter gene or both to facilitate identification and selection of expressing cells from the population of cells sought to be transfected or infected through viral vectors. In other aspects, the selectable marker may be carried on a separate piece of DNA and used in a co-transfection procedure. Both selectable markers and reporter genes may be flanked with appropriate regulatory sequences to enable expression in the host cells. Useful selectable markers include, for example, antibiotic-resistance genes, such as neo and the like.

Reporter genes are used for identifying potentially transfected cells and for evaluating the functionality of regulatory sequences. In general, a reporter gene is a gene that is not present in or expressed by the recipient organism or tissue and that encodes a polypeptide whose expression is manifested by some easily detectable property, e.g., enzymatic activity. Expression of the reporter gene is assayed at a suitable time after the DNA has been introduced into the recipient cells. Suitable reporter genes may include genes encoding luciferase, beta-galactosidase, chloramphenicol acetyl transferase, secreted alkaline phosphatase, or the green fluorescent protein gene (e.g., Ui-Tei et al., 2000 FEBS Letters 479: 79-82). Suitable expression systems are well known and may be prepared using known techniques or obtained commercially. In general, the construct with the minimal 5' flanking region showing the highest level of expression of reporter gene is identified as the promoter. Such promoter regions may be linked to a reporter gene and used to evaluate agents for the ability to modulate promoter-driven transcription.

In embodiments, the vector may comprise two or more nucleic acid sequences encoding a CAR, e.g., a first CAR that binds to CD19 and a second CAR, e.g., an inhibitory CAR or a CAR that specifically binds to a second antigen, e.g., CD10, CD20, CD22, CD34, CD123, FLT-3, ROR1, CD79b, CD179b, or CD79a. In such embodiments, the two or more nucleic acid sequences encoding the CAR are encoded by a single nucleic molecule in the same frame and as a single polypeptide chain. In this aspect, the two or more CARs, can, e.g., be separated by one or more peptide cleavage sites. (e.g., an auto-cleavage site or a substrate for an intracellular protease). Examples of peptide cleavage sites include the following, wherein the GSG residues are optional:

T2A:
(SEQ ID NO: 1328)
(GSG) EGRGSLLTCGDVEENPGP

P2A:
(SEQ ID NO: 1329)
(GSG) ATNFSLLKQAGDVEENPGP

E2A:
(SEQ ID NO: 1330)
(GSG) QCTNYALLKLAGDVESNPGP

F2A:
(SEQ ID NO: 1331)
(GSG) VKQTLNFDLLKLAGDVESNPGP

Methods of introducing and expressing genes into a cell are known in the art. In the context of an expression vector, the vector can be readily introduced into a host cell, e.g., mammalian, bacterial, yeast, or insect cell by any method in the art. For example, the expression vector can be transferred into a host cell by physical, chemical, or biological means.

Physical methods for introducing a polynucleotide into a host cell include calcium phosphate precipitation, lipofection, particle bombardment, microinjection, electroporation, and the like. Methods for producing cells comprising vectors and/or exogenous nucleic acids are well-known in the art. See, for example, Sambrook et al., 2012, MOLECULAR CLONING: A LABORATORY MANUAL, volumes 1-4, Cold Spring Harbor Press, NY). A suitable method for the introduction of a polynucleotide into a host cell is calcium phosphate transfection Biological methods for introducing a polynucleotide of interest into a host cell include the use of DNA and RNA vectors. Viral vectors, and especially retroviral vectors, have become the most widely used method for inserting genes into mammalian, e.g., human cells. Other viral vectors can be derived from lentivirus, poxviruses, herpes simplex virus I, adenoviruses and adeno-associated viruses, and the like. See, for example, U.S. Pat. Nos. 5,350,674 and 5,585,362.

Chemical means for introducing a polynucleotide into a host cell include colloidal dispersion systems, such as macromolecule complexes, nanocapsules, microspheres, beads, and lipid-based systems including oil-in-water emulsions, micelles, mixed micelles, and liposomes. An exemplary colloidal system for use as a delivery vehicle in vitro and in vivo is a liposome (e.g., an artificial membrane vesicle). Other methods of state-of-the-art targeted delivery of nucleic acids are available, such as delivery of polynucleotides with targeted nanoparticles or other suitable submicron sized delivery system.

In the case where a non-viral delivery system is utilized, an exemplary delivery vehicle is a liposome. The use of lipid formulations is contemplated for the introduction of the nucleic acids into a host cell (in vitro, ex vivo or in vivo). In another aspect, the nucleic acid may be associated with a lipid. The nucleic acid associated with a lipid may be encapsulated in the aqueous interior of a liposome, interspersed within the lipid bilayer of a liposome, attached to a liposome via a linking molecule that is associated with both the liposome and the oligonucleotide, entrapped in a liposome, complexed with a liposome, dispersed in a solution containing a lipid, mixed with a lipid, combined with a lipid, contained as a suspension in a lipid, contained or complexed with a micelle, or otherwise associated with a lipid. Lipid, lipid/DNA or lipid/expression vector associated compositions are not limited to any particular structure in solution. For example, they may be present in a bilayer structure, as micelles, or with a "collapsed" structure. They may also simply be interspersed in a solution, possibly forming aggregates that are not uniform in size or shape. Lipids are fatty substances which may be naturally occurring or synthetic lipids. For example, lipids include the fatty droplets that naturally occur in the cytoplasm as well as the class of compounds which contain long-chain aliphatic hydrocarbons and their derivatives, such as fatty acids, alcohols, amines, amino alcohols, and aldehydes.

Lipids suitable for use can be obtained from commercial sources. For example, dimyristyl phosphatidylcholine ("DMPC") can be obtained from Sigma, St. Louis, Mo.; dicetyl phosphate ("DCP") can be obtained from K & K Laboratories (Plainview, N.Y.); cholesterol ("Chol") can be obtained from Calbiochem-Behring; dimyristyl phosphatidylglycerol ("DMPG") and other lipids may be obtained from Avanti Polar Lipids, Inc. (Birmingham, Ala.). Stock solutions of lipids in chloroform or chloroform/methanol can be stored at about −20° C. Chloroform is used as the only solvent since it is more readily evaporated than methanol. "Liposome" is a generic term encompassing a variety of single and multilamellar lipid vehicles formed by the generation of enclosed lipid bilayers or aggregates. Liposomes can be characterized as having vesicular structures with a phospholipid bilayer membrane and an inner aqueous medium. Multilamellar liposomes have multiple lipid layers separated by aqueous medium. They form spontaneously when phospholipids are suspended in an excess of aqueous solution. The lipid components undergo self-rearrangement before the formation of closed structures and entrap water and dissolved solutes between the lipid bilayers (Ghosh et al., 1991 Glycobiology 5: 505-10). However, compositions that have different structures in solution than the normal vesicular structure are also encompassed. For example, the lipids may assume a micellar structure or merely exist as nonuniform aggregates of lipid molecules. Also contemplated are lipofectamine-nucleic acid complexes.

Regardless of the method used to introduce exogenous nucleic acids into a host cell or otherwise expose a cell to the inhibitor of the present invention, in order to confirm the presence of the recombinant DNA sequence in the host cell, a variety of assays may be performed. Such assays include, for example, "molecular biological" assays well known to those of skill in the art, such as Southern and Northern blotting, RT-PCR and PCR; "biochemical" assays, such as detecting the presence or absence of a particular peptide, e.g., by immunological means (ELISAs and Western blots) or by assays described herein to identify agents falling within the scope of the invention.

The present invention further provides a vector comprising a CAR encoding nucleic acid molecule. In one aspect, a CAR vector can be directly transduced into a cell, e.g., a T cell. In one aspect, the vector is a cloning or expression vector, e.g., a vector including, but not limited to, one or more plasmids (e.g., expression plasmids, cloning vectors, minicircles, minivectors, double minute chromosomes), retroviral and lentiviral vector constructs. In one aspect, the vector is capable of expressing the CAR construct in mammalian T cells. In one aspect, the mammalian T cell is a human T cell.

Immune Effector Cells Expressing a CAR

In another aspect, the present invention provides a population of CAR-expressing cells. In some embodiments, the population of CAR-expressing cells comprises a cell that expresses one or more CARs described herein. In some embodiments, the population of CAR-expressing cells comprises a mixture of cells expressing different CARs.

For example, in one embodiment, the population of CART cells can include a first cell expressing a CAR having an antigen binding domain to a tumor antigen described herein, e.g., CD19, and a second cell expressing a CAR having a different antigen binding domain, e.g., an antigen binding domain to a different tumor antigen described herein, e.g., an antigen binding domain to a tumor antigen described herein that differs from the tumor antigen bound by the antigen binding domain of the CAR expressed by the first cell, e.g., CD10, CD20, CD22, CD34, CD123, FLT-3, ROR1, CD79b, CD179b, or CD79a.

As another example, the population of CAR-expressing cells can include a first cell expressing a CAR that includes an antigen binding domain to a tumor antigen described herein, and a second cell expressing a CAR that includes an antigen binding domain to a target other than a tumor antigen as described herein. In one embodiment, the population of CAR-expressing cells includes, e.g., a first cell expressing a CAR that includes a primary intracellular signaling domain, and a second cell expressing a CAR that includes a secondary signaling domain. Either one or both of the CAR expressing cells can have a truncated PGK promoter, e.g., as described herein, operably linked to the nucleic acid encoding the CAR.

In another aspect, the present invention provides a population of cells wherein at least one cell in the population expresses a CAR having an antigen binding domain to a tumor antigen described herein, and a second cell expressing another agent, e.g., an agent which enhances the activity of a CAR-expressing cell. The CAR expressing cells of the population can have a truncated PGK promoter, e.g., as described herein, operably linked to the nucleic acid encoding the CAR. In one embodiment, the agent can be an agent which inhibits an inhibitory molecule. Inhibitory molecules, e.g., PD-1, can, in some embodiments, decrease the ability of a CAR-expressing cell to mount an immune effector response. Examples of inhibitory molecules include PD-1, PD-L1, PD-L2, CTLA4, TIM3, CEACAM (CEACAM-1, CEACAM-3, and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GALS, adenosine, and TGFR (e.g., TGFRbeta). In one embodiment, the agent which inhibits an inhibitory molecule comprises a first polypeptide, e.g., an inhibitory molecule, associated with a second polypeptide that provides a positive signal to the cell, e.g., an intracellular signaling domain described herein. In one embodiment, the agent comprises a first polypeptide, e.g., of an inhibitory molecule such as PD1, PD-L1, CTLA4, TIM3, CEACAM (e.g., CEACAM-1, CEACAM-3, and/or CEACAM-5), LAG3, VISTA, BTLA, TIGIT, LAIR1, CD160, 2B4 or TGFR beta, or a fragment of any of these, and a second polypeptide which is an intracellular signaling domain described herein (e.g., comprising a costimulatory domain (e.g., 41BB, CD27, OX40 or CD28, e.g., as described herein) and/or a primary signaling domain (e.g., a CD3 zeta signaling domain described herein). In one embodiment, the agent comprises a first polypeptide of PD-1 or a fragment thereof, and a second polypeptide of an intracellular signaling domain described herein (e.g., a CD28 signaling domain described herein and/or a CD3 zeta signaling domain described herein).

Co-Expression of CAR with Other Molecules or Agents

Co-Expression of a Second CAR

In one aspect, the CAR-expressing cell described herein can further comprise a second CAR, e.g., a second CAR that includes a different antigen binding domain, e.g., to the same target (CD19) or a different target (e.g., CD10, CD20, CD22, CD34, CD123, FLT-3, ROR1, CD79b, CD179b, or CD79a). In one embodiment, the second CAR includes an antigen binding domain to a target expressed on acute myeloid leukemia cells, such as, e.g., CD20, CD22, ROR1, CD10, CD33, CLL-1, CD34, CD123, FLT3, CD79b, CD179b, and CD79a. In one embodiment, the CAR-expressing cell comprises a first CAR that targets a first antigen and includes an intracellular signaling domain having a costimulatory signaling domain but not a primary signaling domain, and a second CAR that targets a second, different, antigen and includes an intracellular signaling domain having a primary signaling domain but not a costimulatory signaling domain. While not wishing to be bound by theory, placement of a costimulatory signaling domain, e.g., 4-1BB, CD28, CD27 or OX-40, onto the first CAR, and the primary signaling domain, e.g., CD3 zeta, on the second CAR can limit the CAR activity to cells where both targets are expressed. In one embodiment, the CAR expressing cell comprises a first CD19 CAR that includes a CD19 binding domain, a transmembrane domain and a costimulatory domain and a second CAR that targets an antigen other than CD19 (e.g., an antigen expressed on AML cells, e.g., CD22, CD20, ROR1, CD10, CD33, CLL-1, CD34, CD123, FLT3, CD79b, CD179b, or CD79a) and includes an antigen binding domain, a transmembrane domain and a primary signaling domain. In another embodiment, the CAR expressing cell comprises a first CD19 CAR that includes a CD19 binding domain, a transmembrane domain and a primary signaling domain and a second CAR that targets an antigen other than CD19 (e.g., an antigen expressed on AML cells, e.g., CD22, CD20, ROR1, CD10, CD33, CD123, CLL-1, CD34, FLT3, CD79b, CD179b, or CD79a) and includes an antigen binding domain to the antigen, a transmembrane domain and a costimulatory signaling domain.

In one aspect, the CAR-expressing cell described herein can further comprise a second CAR, e.g., a second CAR that includes a different antigen binding domain, e.g., to the same target (CD19) or a different target (e.g., a target other than CD19, e.g., CD10, CD20, CD22, CD34, CD123, FLT-3, ROR1, CD79b, CD179b, or CD79a). In one embodiment, the CAR-expressing cell comprises a first CAR that targets a first antigen and includes an intracellular signaling domain having a costimulatory signaling domain but not a primary signaling domain, and a second CAR that targets a second, different, antigen and includes an intracellular signaling domain having a primary signaling domain but not a costimulatory signaling domain. Placement of a costimulatory signaling domain, e.g., 4-1BB, CD28, CD27, OX-40 or ICOS, onto the first CAR, and the primary signaling domain, e.g., CD3 zeta, on the second CAR can limit the CAR activity to cells where both targets are expressed. In one embodiment, the CAR expressing cell comprises a first CAR that includes an antigen binding domain, a transmembrane domain and a costimulatory domain and a second CAR that targets another antigen and includes an antigen binding domain, a transmembrane domain and a primary signaling domain. In another embodiment, the CAR expressing cell comprises a first CAR that includes an antigen binding domain, a transmembrane domain and a primary signaling domain and a second CAR that targets another antigen and includes an antigen binding domain to the antigen, a transmembrane domain and a costimulatory signaling domain.

In one embodiment, the CAR-expressing cell comprises an XCAR described herein (e.g., CD19 CAR, CD20 CAR, or CD22 CAR) and an inhibitory CAR. In one embodiment, the CAR-expressing cell comprises a CD19 CAR described herein and an inhibitory CAR. In one embodiment, the inhibitory CAR comprises an antigen binding domain that binds an antigen found on normal cells but not cancer cells, e.g., normal cells that also express CD19. In one embodiment, the inhibitory CAR comprises the antigen binding domain, a transmembrane domain and an intracellular domain of an inhibitory molecule. For example, the intracellular domain of the inhibitory CAR can be an intracellular domain PD-1, PD-L1, PD-L2, CTLA4, TIM3, CEACAM (CEACAM-1, CEACAM-3, and/or CEACAM-5), LAGS, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GALS, adenosine, and TGFR (e.g., TGFRbeta).

In one embodiment, when the CAR-expressing cell comprises two or more different CARs, the antigen binding domains of the different CARs can be such that the antigen binding domains do not interact with one another. For example, a cell expressing a first and second CAR can have an antigen binding domain of the first CAR, e.g., as a fragment, e.g., an scFv, that does not form an association with the antigen binding domain of the second CAR, e.g., the antigen binding domain of the second CAR is a VHH.

Co-Expression of an Agent that Enhances CAR Activity

In another aspect, the CAR-expressing cell described herein can further express another agent, e.g., an agent that enhances the activity or fitness of a CAR-expressing cell.

For example, in one embodiment, the agent can be an agent which inhibits a molecule that modulates or regulates, e.g., inhibits, T cell function. In some embodiments, the molecule that modulates or regulates T cell function is an inhibitory molecule. Inhibitory molecules, e.g., PD1, can, in some embodiments, decrease the ability of a CAR-expressing cell to mount an immune effector response. Examples of inhibitory molecules include PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGFR (e.g., TGFR beta).

In one embodiment, an inhibitory nucleic acid, e.g., an inhibitory nucleic acid, e.g., a dsRNA, e.g., an siRNA or shRNA, a clustered regularly interspaced short palindromic repeats (CRISPR), a transcription-activator like effector nuclease (TALEN), or a zinc finger endonuclease (ZFN), e.g., as described herein, can be used to inhibit expression of a molecule that modulates or regulates, e.g., inhibits, T-cell function in the CAR-expressing cell. In an embodiment the agent is an shRNA, e.g., an shRNA described herein. In an embodiment, the agent that modulates or regulates, e.g., inhibits, T-cell function is inhibited within a CAR-expressing cell. For example, a dsRNA molecule that inhibits expression of a molecule that modulates or regulates, e.g., inhibits, T-cell function is linked to the nucleic acid that encodes a component, e.g., all of the components, of the CAR.

In one embodiment, the agent which inhibits an inhibitory molecule comprises a first polypeptide, e.g., an inhibitory molecule, associated with a second polypeptide that provides a positive signal to the cell, e.g., an intracellular signaling domain described herein. In one embodiment, the agent comprises a first polypeptide, e.g., of an inhibitory molecule such as PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, or TGFR (e.g., TGFR beta), or a fragment of any of these (e.g., at least a portion of an extracellular domain of any of these), and a second polypeptide which is an intracellular signaling domain described herein (e.g., comprising a costimulatory domain (e.g., 41BB, CD27 or CD28, e.g., as described herein) and/or a primary signaling domain (e.g., a CD3 zeta signaling domain described herein). In one embodiment, the agent comprises a first polypeptide of PD1 or a fragment thereof (e.g., at least a portion of an extracellular domain of PD1), and a second polypeptide of an intracellular signaling domain described herein (e.g., a CD28 signaling domain described herein and/or a CD3 zeta signaling domain described herein). PD1 is an inhibitory member of the CD28 family of receptors that also includes CD28, CTLA-4, ICOS, and BTLA. PD-1 is expressed on activated B cells, T cells and myeloid cells (Agata et al. 1996 Int. Immunol 8:765-75). Two ligands for PD1, PD-L1 and PD-L2 have been shown to downregulate T cell activation upon binding to PD1 (Freeman et a. 2000 J Exp Med 192:1027-34; Latchman et al. 2001 Nat Immunol 2:261-8; Carter et al. 2002 Eur J Immunol 32:634-43). PD-L1 is abundant in human cancers (Dong et al. 2003 J Mol Med 81:281-7; Blank et al. 2005 Cancer Immunol. Immunother 54:307-314; Konishi et al. 2004 Clin Cancer Res 10:5094). Immune suppression can be reversed by inhibiting the local interaction of PD1 with PD-L1.

In one embodiment, the agent comprises the extracellular domain (ECD) of an inhibitory molecule, e.g., Programmed Death 1 (PD1), can be fused to a transmembrane domain and intracellular signaling domains such as 41BB and CD3 zeta (also referred to herein as a PD1 CAR). In one embodiment, the PD1 CAR, when used in combinations with a CD19 CAR described herein, improves the persistence of the T cell. In one embodiment, the CAR is a PD1 CAR comprising the extracellular domain of PD1 indicated as underlined in SEQ ID NO: 121. In one embodiment, the PD1 CAR comprises the amino acid sequence of SEQ ID NO:121.

```
                                            (SEQ ID NO: 121)
Malpvtalllplalllhaarppqwfldspdrpwnpptfspallvvteqdn atftcsfsntsesfvlnwyrmspsnqtdklaafpedrsqpgqdcrfrvtq lpngrdfhmsvvrarrndsqtylcqaislapkaqikeslraelrvterra evptahpspsprpaggfqtlvtttpaprpptpaptiasqplslrpeacrp aaggavhtrgldfacdiyiwaplagtcgvlllslvitlyckrgrkkllyi fkqpfmrpvqttqeedgcscrfpeeeeggcelrvkfsrsadapaykqgqn qlynelnlgrreeydvldkrrgrdpemggkprrknpqeglynelqkdkma eayseigmkgerrrgkghdglyqglstatkdtydalhmqalppr.
```

In one embodiment, the PD1 CAR comprises the amino acid sequence provided below (SEQ ID NO:119).

```
                                            (SEQ ID NO: 119)
pqwfldspdrpwnpptfspallvvteqdnatftcsfsntsesfylnwyrm spsnqtdklaafpedrsqpgqdcrfrvtqlpngrdfhmsvvrarrndsgt ylcqaislapkaqikeslraelniterraevptahpspsprpaggfqtlv tttpaprpptpaptiasqplslrpeacrpaaggavhtrgldfacdiyiwa plagtcgvlllslvitlyckrgrkkllyifkqpfmrpvqttqeedgcscr fpeeeeggcelrvkfsrsadapaykqgqnqlynelnlgrreeydvldkrr grdpemggkprrknpqeglynelqkdkmaeayseigmkgerrrgkghdgl yqglstatkdtydalhmqalppr.
```

Tin one embodiment, the agent comprises a nucleic acid sequence encoding the PD1 CAR, e.g., the PD1 CAR described herein. In one embodiment, the nucleic acid sequence for the PD1 CAR is shown below, with the PD1 ECD underlined below in SEQ ID NO: 120

```
                                            (SEQ ID NO: 120)
atggccctccctgtcactgccctgcttctccccctcgcactcctgctcca cgccgctagaccacccggatggtttctggactctccggatcgcccgtgga atccccaaccttctcaccggcactcttggttgtgactgagggcgataat gcgaccttcacgtgctcgttctccaacacctccgaatcattcgtgctgaa ctggtaccgcatgagcccgtcaaaccagaccgacaagctcgccgcgtttc cggaagatcggtcgcaaccgggacaggattgtcggttccgcgtgactcaa ctgccgaatggcagagacttccacatgagcgtggtccgcgctaggcgaaa cgactccgggacctacctgtgcggagccatctcgctggcgcctaaggccc aaatcaaagagagcttgagggccgaactgagagtgaccgagcgcagagct gaggtgccaactgcacatccatccccatcgcctcggcctgcggggcagtt tcagacctggtcacgaccactccggcgccgcgcccaccgactccggccc caactatcgcgagccagccctgtcgctgaggccggaagcatgccgccct gccgccggaggtgctgtgcataccggggattggacttcgcatgcgacat ctacatttgggctcctctcgccggaacttgtggcgtgctccttctgtccc tggtcatcaccctgtactgcaagcggggtcggaaaaagcttctgtacatt
```

```
ttcaagcagccct tcatgaggcccgtgcaaaccacccaggaggaggacgg ttgctcctgccggttccccgaagaggaagaaggaggttgcgagctgcgcg tgaagttctcccggagcgccgacgccccgcctataagcagggccagaac cagctgtacaacgaactgaacctgggacggcgggaagagtacgatgtgct ggacaagcggcggccgggaccccgaaatgggcgggaagcctagaagaa agaaccctcaggaaggcctgtataacgagctgcagaaggacaagatggcc gaggcctactccgaaattgggatgaagggagagcggcggaggggaaggg gcacgacggcctgtaccaaggactgtccaccgccaccaaggacacatacg atgccctgcacatgcaggccct tccccctcgc.
```

In another example, in one embodiment, the agent which enhances the activity of a CAR-expressing cell can be a costimulatory molecule or costimulatory molecule ligand. Examples of costimulatory molecules include MHC class I molecule, BTLA and a Toll ligand receptor, as well as OX40, CD27, CD28, CDS, ICAM-1, LFA-1 (CD11a/CD18), ICOS (CD278), and 4-1BB (CD137). Further examples of such costimulatory molecules include CDS, ICAM-1, GITR, BAFFR, HVEM (LIGHTR), SLAMF7, NKp80 (KLRF1), NKp44, NKp30, NKp46, CD160, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, CD19a, and a ligand that specifically binds with CD83, e.g., as described herein. Examples of costimulatory molecule ligands include CD80, CD86, CD40L, ICOSL, CD70, OX40L, 4-1BBL, GITRL, and LIGHT. In embodiments, the costimulatory molecule ligand is a ligand for a costimulatory molecule different from the costimulatory molecule domain of the CAR. In embodiments, the costimulatory molecule ligand is a ligand for a costimulatory molecule that is the same as the costimulatory molecule domain of the CAR. In an embodiment, the costimulatory molecule ligand is 4-1BBL. In an embodiment, the costimulatory ligand is CD80 or CD86. In an embodiment, the costimulatory molecule ligand is CD70. In embodiments, a CAR-expressing immune effector cell described herein can be further engineered to express one or more additional costimulatory molecules or costimulatory molecule ligands.

Co-Expression of CAR with a Chemokine Receptor

In embodiments, the CAR-expressing cell described herein further comprises a chemokine receptor molecule. Transgenic expression of chemokine receptors CCR2b or CXCR2 in T cells enhances trafficking to CCL2- or CXCL1-secreting solid tumors including melanoma and neuroblastoma (Craddock et al., *J Immunother.* 2010 October; 33(8): 780-8 and Kershaw et al., *Hum Gene Ther.* 2002 Nov. 1; 13(16):1971-80). Thus, without wishing to be bound by theory, it is believed that chemokine receptors expressed in CAR-expressing cells that recognize chemokines secreted by tumors, e.g., solid tumors, can improve homing of the CAR-expressing cell to the tumor, facilitate the infiltration of the CAR-expressing cell to the tumor, and enhances antitumor efficacy of the CAR-expressing cell. The chemokine receptor molecule can comprise a naturally occurring or recombinant chemokine receptor or a chemokine-binding fragment thereof. A chemokine receptor molecule suitable for expression in a CAR-expressing cell described herein include a CXC chemokine receptor (e.g., CXCR1, CXCR2, CXCR3, CXCR4, CXCR5, CXCR6, or CXCR7), a CC chemokine receptor (e.g., CCR1, CCR2, CCR3, CCR4, CCR5, CCR6, CCR7, CCR8, CCR9, CCR10, or CCR11), a CX3C chemokine receptor (e.g., CX3CR1), a XC chemokine receptor (e.g., XCR1), or a chemokine-binding fragment thereof. In one embodiment, the chemokine receptor molecule to be expressed with a CAR described herein is selected based on the chemokine(s) secreted by the tumor. In one embodiment, the CAR-expressing cell described herein further comprises, e.g., expresses, a CCR2b receptor or a CXCR2 receptor. In an embodiment, the CAR described herein and the chemokine receptor molecule are on the same vector or are on two different vectors. In embodiments where the CAR described herein and the chemokine receptor molecule are on the same vector, the CAR and the chemokine receptor molecule are each under control of two different promoters or are under the control of the same promoter.

Conditional Expression of Immune Response-Enhancing Agents

Also provided herein are compositions and methods for conditionally expressing an agent that enhances the immune response or activity of a CAR-expressing cell described herein.

In one aspect, the present disclosure features an immune effector cell that is engineered to constitutively express a CAR, also referred to herein as a nonconditional CAR. In one embodiment, a nonconditional CAR as described herein comprises an antigen binding domain that binds to a cancer associated antigen, e.g., CD19, CD10, CD20, CD22, CD34, CD123, FLT-3, or ROR1. In embodiments, the nonconditional CAR-expressing immune effector cell further comprises a conditionally-expressed agent that enhances the therapeutic efficacy, e.g., the immune response, of the CAR-expressing immune effector cell. In such embodiments, the expression of the conditionally expressed agent occurs upon activation of the nonconditional CAR-expressing immune effector cell, e.g., upon binding of the nonconditional CAR molecule to its target, e.g., a cancer associated antigen, e.g., CD19, CD10, CD20, CD22, CD34, CD123, FLT-3, or ROR1.

Immune response-enhancing agents as described herein can be characterized by one or more of the following: 1) targets or binds to a different cancer associated antigen than that targeted by the nonconditional CAR; 2) inhibits the expression or activity of an immune checkpoint or inhibitory molecule; and/or 3) activates the expression and/or secretion of a component that enhances immune response or activation of an immune effector cell. The immune response-enhancing agent can be a polypeptide or a nucleic acid, e.g., a nucleic acid that encodes a polypeptide that enhances immune response. Examples of conditionally expressed agents that enhance the immune response include, but are not limited to, an additional CAR (referred to as a conditional CAR); a TCR-based molecule (e.g., a TCR-CAR); an inhibitor of an immune checkpoint or an inhibitory molecule; and/or a cytokine. In embodiments, the conditional CAR binds to a different cancer associated antigen than that targeted by the nonconditional CAR. In embodiments, the inhibitor of an immune checkpoint or inhibitory molecule described herein is an antibody or antigen binding fragment thereof, an inhibitory nucleic acid (e.g., an siRNA or shRNA), or a small molecule that inhibits or decreases the activity of an immune checkpoint or inhibitory molecule selected from PD1, PD-L1, CTLA4, TIM3, CEACAM (e.g., CEACAM-1, CEACAM-3 and/or CEACAM-5), LAGS, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GALS, adenosine, or TGFR beta. In embodiments, the cytokine comprises IL-2, IL-7, IL-15, or IL-21, or functional fragments or derivatives thereof.

In embodiments, the immune effector cell comprises a nonconditional CAR and one or more conditional CARs, where the conditional CAR binds to a different cancer associated antigen than that targeted by the nonconditional CAR. By way of example, in one embodiment, an immune effector cell comprises a nonconditional CAR that binds to CD19 and one or more conditional CARs that bind to CD10, CD20, CD22, CD34, CD123, FLT-3, or ROR1, or a combination thereof. In another embodiment, an immune effector cell comprises a nonconditional CAR that binds to CD10, CD20, CD22, CD34, CD123, FLT-3, or ROR1 and a conditional CAR that binds to CD19.

Conditional expression of the agent that enhances the immune response upon activation of the CAR-expressing immune effector cell is achieved by operatively linking an activation-conditional control region to the agent that enhances the immune response (e.g., to a nucleic acid sequence encoding such an agent). In one embodiment, the activation conditional control region comprises a promoter sequence that initiates expression, e.g., transcription, of the operatively linked immune response enhancing agent upon activation of the immune effector cell. In one embodiment, the activation conditional control region comprises one or more regulatory sequences (e.g., a transcription factor binding sequence or site) that facilitate the initiation of expression upon activation of the immune effector cell. In embodiments, the activation-conditional control region comprises a promoter sequence and/or one or more transcription factor binding sequences from a promoter or regulatory sequence of a gene that is upregulated upon one or more of the following: immune effector cell (e.g., T cell) activation, T-cell differentiation, T-cell polarization, or helper T cell development. Examples of such genes include, but are not limited to, NFAT (nuclear factor of activated T cells), ATF2 (activating transcription factor 2), NF-κB (nuclear factor-KB), IL-2, IL-2 receptor (IL-2R), IL-3, GM-CSF, IL-4, IL-10, and IFN-γ.

In one embodiment, the activation-conditional control region comprises one or more, e.g., 1, 2, 3, 4, 5, 6, or more, NFAT binding sequences or sites. In embodiments, the NFAT-binding sequence in the promoter comprises (5'-GGAAA-3') (SEQ ID NO: 1312), optionally situated in a longer consensus sequence of 5' (A/T)GGAAA(A/N)(A/T/C)N 3' (SEQ ID NO: 1313). In embodiments, the NFAT-binding sequence is a Kb-like sequence such as GGGACT (SEQ ID NO: 1314). (See, Gibson et al., The Journal of Immunology, 2007, 179: 3831-3840.)

In one embodiment, the activation-conditional control region further comprises an IL-2 promoter (or a minimal IL-2 promoter), an IL-2R promoter, an ATF2 promoter, or a NF-κB promoter, or any functional fragment or derivative thereof. In one embodiment, the activation-conditional control region comprises one or more NFAT-binding sequences, e.g., 3 or 6 NFAT-binding sequences, and an IL-2 promoter, e.g., an IL-2 minimal promoter. In one embodiment, the activation-conditional control region comprises the sequence of AGCTTGGATCCAAGAGGAAAATTT-GTTTCATACAGAAGGCGTTAAGAGGAAAATT TGTTTCATACAGAAGGCGTTAAGAGGAAAATTT-GTTTCATACAGAAGGCGTTCAAG CTTGTCGAC (SEQ ID NO: 1315).

Sources of Cells

Prior to expansion and genetic modification or other modification, a source of cells, e.g., T cells or natural killer (NK) cells, can be obtained from a subject. Examples of subjects include humans, monkeys, chimpanzees, dogs, cats, mice, rats, and transgenic species thereof. T cells can be obtained from a number of sources, including peripheral blood mononuclear cells, bone marrow, lymph node tissue, cord blood, thymus tissue, tissue from a site of infection, ascites, pleural effusion, spleen tissue, and tumors.

In certain aspects of the present disclosure, immune effector cells, e.g., T cells, can be obtained from a unit of blood collected from a subject using any number of techniques known to the skilled artisan, such as Ficoll™ separation. In one aspect, cells from the circulating blood of an individual are obtained by apheresis. The apheresis product typically contains lymphocytes, including T cells, monocytes, granulocytes, B cells, other nucleated white blood cells, red blood cells, and platelets. In one aspect, the cells collected by apheresis may be washed to remove the plasma fraction and, optionally, to place the cells in an appropriate buffer or media for subsequent processing steps. In one embodiment, the cells are washed with phosphate buffered saline (PBS). In an alternative embodiment, the wash solution lacks calcium and may lack magnesium or may lack many if not all divalent cations.

Initial activation steps in the absence of calcium can lead to magnified activation. As those of ordinary skill in the art would readily appreciate a washing step may be accomplished by methods known to those in the art, such as by using a semi-automated "flow-through" centrifuge (for example, the Cobe 2991 cell processor, the Baxter CytoMate, or the Haemonetics Cell Saver 5) according to the manufacturer's instructions. After washing, the cells may be resuspended in a variety of biocompatible buffers, such as, for example, Ca-free, Mg-free PBS, PlasmaLyte A, or other saline solution with or without buffer. Alternatively, the undesirable components of the apheresis sample may be removed and the cells directly resuspended in culture media.

It is recognized that the methods of the application can utilize culture media conditions comprising 5% or less, for example 2%, human AB serum, and employ known culture media conditions and compositions, for example those described in Smith et al., "Ex vivo expansion of human T cells for adoptive immunotherapy using the novel Xeno-free CTS Immune Cell Serum Replacement" Clinical & Translational Immunology (2015) 4, e31; doi:10.1038/cti.2014.31.

In one aspect, T cells are isolated from peripheral blood lymphocytes by lysing the red blood cells and depleting the monocytes, for example, by centrifugation through a PERCOLL™ gradient or by counterflow centrifugal elutriation.

The methods described herein can include, e.g., selection of a specific subpopulation of immune effector cells, e.g., T cells, that are a T regulatory cell-depleted population, CD25+ depleted cells, using, e.g., a negative selection technique, e.g., described herein. In some embodiments, the population of T regulatory depleted cells contains less than 30%, 25%, 20%, 15%, 10%, 5%, 4%, 3%, 2%, 1% of CD25+ cells.

In one embodiment, T regulatory cells, e.g., CD25+ T cells, are removed from the population using an anti-CD25 antibody, or fragment thereof, or a CD25-binding ligand, IL-2. In one embodiment, the anti-CD25 antibody, or fragment thereof, or CD25-binding ligand is conjugated to a substrate, e.g., a bead, or is otherwise coated on a substrate, e.g., a bead. In one embodiment, the anti-CD25 antibody, or fragment thereof, is conjugated to a substrate as described herein.

In one embodiment, the T regulatory cells, e.g., CD25+ T cells, are removed from the population using CD25 depletion reagent from Miltenyi™. In one embodiment, the ratio of cells to CD25 depletion reagent is 1e7 cells to 20 uL, or 1e7 cells to 15 uL, or 1e7 cells to 10 uL, or 1e7 cells to 5 uL, or 1e7 cells to 2.5 uL, or 1e7 cells to 1.25 uL. In one embodiment, e.g., for T regulatory cells, e.g., CD25+ depletion, greater than 500 million cells/ml is used. In a further aspect, a concentration of cells of 600, 700, 800, or 900 million cells/ml is used.

In one embodiment, the population of immune effector cells to be depleted includes about $6 \times 10^9$ CD25+ T cells. In other aspects, the population of immune effector cells to be depleted include about $1 \times 10^9$ to $1 \times 10^{10}$ CD25+ T cell, and any integer value in between. In one embodiment, the resulting population T regulatory depleted cells has $2 \times 10^9$ T regulatory cells, e.g., CD25+ cells, or less (e.g., $1 \times 10^9$, $5 \times 10^8$, $1 \times 10^8$, $5 \times 10^7$, $1 \times 10^7$, or less CD25+ cells).

In one embodiment, the T regulatory cells, e.g., CD25+ cells, are removed from the population using the CliniMAC system with a depletion tubing set, such as, e.g., tubing 162-01. In one embodiment, the CliniMAC system is run on a depletion setting such as, e.g., DEPLETION2.1.

Without wishing to be bound by a particular theory, decreasing the level of negative regulators of immune cells (e.g., decreasing the number of unwanted immune cells, e.g., $T_{REG}$ cells), in a subject prior to apheresis or during manufacturing of a CAR-expressing cell product significantly reduces the risk of subject relapse. For example, methods of depleting $T_{REG}$ cells are known in the art. Methods of decreasing $T_{REG}$ cells include, but are not limited to, cyclophosphamide, anti-GITR antibody (an anti-GITR antibody described herein), CD25-depletion, mTOR inhibitor, and combinations thereof.

In some embodiments, the manufacturing methods comprise reducing the number of (e.g., depleting) $T_{REG}$ cells prior to manufacturing of the CAR-expressing cell. For example, manufacturing methods comprise contacting the sample, e.g., the apheresis sample, with an anti-GITR antibody and/or an anti-CD25 antibody (or fragment thereof, or a CD25-binding ligand), e.g., to deplete $T_{REG}$ cells prior to manufacturing of the CAR-expressing cell (e.g., T cell, NK cell) product.

Without wishing to be bound by a particular theory, decreasing the level of negative regulators of immune cells (e.g., decreasing the number of unwanted immune cells, e.g., $T_{REG}$ cells), in a subject prior to apheresis or during manufacturing of a CAR-expressing cell product can reduce the risk of a $T_{REG}$ relapse. In an embodiment, a subject is pre-treated with one or more therapies that reduce TREG cells prior to collection of cells for CAR-expressing cell product manufacturing, thereby reducing the risk of subject relapse to CAR-expressing cell treatment. In an embodiment, methods of decreasing $T_{REG}$ cells include, but are not limited to, administration to the subject of one or more of cyclophosphamide, anti-GITR antibody, CD25-depletion, or a combination thereof. In an embodiment, methods of decreasing $T_{REG}$ cells include, but are not limited to, administration to the subject of one or more of cyclophosphamide, anti-GITR antibody, CD25-depletion, mTOR inhibitor, or a combination thereof. Administration of one or more of cyclophosphamide, anti-GITR antibody, CD25-depletion, or a combination thereof, can occur before, during or after an infusion of the CAR-expressing cell product. Administration of one or more of cyclophosphamide, anti-GITR antibody, CD25-depletion, mTOR inhibitor, or a combination thereof, can occur before, during or after an infusion of the CAR-expressing cell product.

In some embodiments, the manufacturing methods comprise reducing the number of (e.g., depleting) $T_{REG}$ cells prior to manufacturing of the CAR-expressing cell. For example, manufacturing methods comprise contacting the sample, e.g., the apheresis sample, with an anti-GITR antibody and/or an anti-CD25 antibody (or fragment thereof, or a CD25-binding ligand), e.g., to deplete $T_{REG}$ cells prior to manufacturing of the CAR-expressing cell (e.g., T cell, NK cell) product.

In an embodiment, a subject is pre-treated with one or more therapies that reduce $T_{REG}$ cells prior to collection of cells for CAR-expressing cell product manufacturing, thereby reducing the risk of subject relapse to CAR-expressing cell treatment. In an embodiment, methods of decreasing $T_{REG}$ cells include, but are not limited to, administration to the subject of one or more of cyclophosphamide, anti-GITR antibody, CD25-depletion, or a combination thereof. Administration of one or more of cyclophosphamide, anti-GITR antibody, CD25-depletion, or a combination thereof, can occur before, during or after an infusion of the CAR-expressing cell product.

In an embodiment, a subject is pre-treated with cyclophosphamide prior to collection of cells for CAR-expressing cell product manufacturing, thereby reducing the risk of subject relapse to CAR-expressing cell treatment. In an embodiment, a subject is pre-treated with an anti-GITR antibody prior to collection of cells for CAR-expressing cell product manufacturing, thereby reducing the risk of subject relapse to CAR-expressing cell treatment.

In one embodiment, the population of cells to be removed are neither the regulatory T cells or tumor cells, but cells that otherwise negatively affect the expansion and/or function of CART cells, e.g. cells expressing CD14, CD11b, CD33, CD15, or other markers expressed by potentially immune suppressive cells. In one embodiment, such cells are envisioned to be removed concurrently with regulatory T cells and/or tumor cells, or following said depletion, or in another order.

The methods described herein can include more than one selection step, e.g., more than one depletion step. Enrichment of a T cell population by negative selection can be accomplished, e.g., with a combination of antibodies directed to surface markers unique to the negatively selected cells. One method is cell sorting and/or selection via negative magnetic immunoadherence or flow cytometry that uses a cocktail of monoclonal antibodies directed to cell surface markers present on the cells negatively selected. For example, to enrich for CD4+ cells by negative selection, a monoclonal antibody cocktail can include antibodies to CD14, CD20, CD11b, CD16, HLA-DR, and CD8.

The methods described herein can further include removing cells from the population which express a tumor antigen, e.g., a tumor antigen that does not comprise CD25, e.g., CD19, CD30, CD38, CD123, CD20, CD14 or CD11b, to thereby provide a population of T regulatory depleted, e.g., CD25+ depleted, and tumor antigen depleted cells that are suitable for expression of a CAR, e.g., a CAR described herein. In one embodiment, tumor antigen expressing cells are removed simultaneously with the T regulatory, e.g., CD25+ cells. For example, an anti-CD25 antibody, or fragment thereof, and an anti-tumor antigen antibody, or fragment thereof, can be attached to the same substrate, e.g., bead, which can be used to remove the cells or an anti-CD25 antibody, or fragment thereof, or the anti-tumor antigen antibody, or fragment thereof, can be attached to separate beads, a mixture of which can be used to remove the cells. In other embodiments, the removal of T regulatory cells, e.g., CD25+ cells, and the removal of the tumor antigen expressing cells is sequential, and can occur, e.g., in either order.

Also provided are methods that include removing cells from the population which express a check point inhibitor, e.g., a check point inhibitor described herein, e.g., one or more of PD1+ cells, LAG3+ cells, and TIM3+ cells, to thereby provide a population of T regulatory depleted, e.g., CD25+ depleted cells, and check point inhibitor depleted cells, e.g., PD1+, LAG3+ and/or TIM3+ depleted cells. Exemplary check point inhibitors include PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GALS, adenosine, and TGFR (e.g., TGFRbeta), e.g., as described herein. In one embodiment, check point inhibitor expressing cells are removed simultaneously with the T regulatory, e.g., CD25+ cells. For example, an anti-CD25 antibody, or fragment thereof, and an anti-check point inhibitor antibody, or fragment thereof, can be attached to the same bead which can be used to remove the cells, or an anti-CD25 antibody, or fragment thereof, and the anti-check point inhibitor antibody, or fragment thereof, can be attached to separate beads, a mixture of which can be used to remove the cells. In other embodiments, the removal of T regulatory cells, e.g., CD25+ cells, and the removal of the check point inhibitor expressing cells is sequential, and can occur, e.g., in either order.

Methods described herein can include a positive selection step. For example, T cells can be isolated by incubation with anti-CD3/anti-CD28 (e.g., 3×28)-conjugated beads, such as DYNABEADS® M-450 CD3/CD28 T, for a time period sufficient for positive selection of the desired T cells. In one aspect, the time period is about 30 minutes. In a further aspect, the time period ranges from 30 minutes to 36 hours or longer and all integer values there between. In a further aspect, the time period is at least 1, 2, 3, 4, 5, or 6 hours. In yet another aspect, the time period is 10 to 24 hours. In one aspect, the incubation time period is 24 hours. Longer incubation times may be used to isolate T cells in any situation where there are few T cells as compared to other cell types, such in isolating tumor infiltrating lymphocytes (TIL) from tumor tissue or from immunocompromised individuals. Further, use of longer incubation times can increase the efficiency of capture of CD8+ T cells. Thus, by simply shortening or lengthening the time T cells are allowed to bind to the CD3/CD28 beads and/or by increasing or decreasing the ratio of beads to T cells (as described further herein), subpopulations of T cells can be preferentially selected for or against at culture initiation or at other time points during the process. Additionally, by increasing or decreasing the ratio of anti-CD3 and/or anti-CD28 antibodies on the beads or other surface, subpopulations of T cells can be preferentially selected for or against at culture initiation or at other desired time points.

In one embodiment, a T cell population can be selected that expresses one or more of IFN-γ, TNFα, IL-17A, IL-2, IL-3, IL-4, GM-CSF, IL-10, IL-13, granzyme B, and perforin, or other appropriate molecules, e.g., other cytokines. Methods for screening for cell expression can be determined, e.g., by the methods described in PCT Publication No.: WO 2013/126712.

For isolation of a desired population of cells by positive or negative selection, the concentration of cells and surface (e.g., particles such as beads) can be varied. In certain aspects, it may be desirable to significantly decrease the volume in which beads and cells are mixed together (e.g., increase the concentration of cells), to ensure maximum contact of cells and beads. For example, in one aspect, a concentration of about 10 billion cells/ml, 9 billion/ml, 8 billion/ml, 7 billion/ml, 6 billion/ml, or 5 billion/ml is used. In one aspect, a concentration of 1 billion cells/ml is used. In one aspect, a concentration of cells from 75, 80, 85, 90, 95, or 100 million cells/ml is used. In further aspects, concentrations of 125 or 150 million cells/ml can be used.

Using high concentrations can result in increased cell yield, cell activation, and cell expansion. Further, use of high cell concentrations allows more efficient capture of cells that may weakly express target antigens of interest, such as CD28-negative T cells, or from samples where there are many tumor cells present (e.g., leukemic blood, tumor tissue, etc.). Such populations of cells may have therapeutic value and would be desirable to obtain. For example, using high concentration of cells allows more efficient selection of CD8+ T cells that normally have weaker CD28 expression.

In a related aspect, it may be desirable to use lower concentrations of cells. By significantly diluting the mixture of T cells and surface (e.g., particles such as beads), interactions between the particles and cells is minimized. This selects for cells that express high amounts of desired antigens to be bound to the particles. For example, CD4+ T cells express higher levels of CD28 and are more efficiently captured than CD8+ T cells in dilute concentrations. In one aspect, the concentration of cells used is $5\times10^6$/ml. In other aspects, the concentration used can be from about $1\times10^5$/ml to $1\times10^6$/ml, and any integer value in between.

In other aspects, the cells may be incubated on a rotator for varying lengths of time at varying speeds at either 2-10° C. or at room temperature.

T cells for stimulation can also be frozen after a washing step. Wishing not to be bound by theory, the freeze and subsequent thaw step provides a more uniform product by removing granulocytes and to some extent monocytes in the cell population. After the washing step that removes plasma and platelets, the cells may be suspended in a freezing solution. While many freezing solutions and parameters are known in the art and will be useful in this context, one method involves using PBS containing 20% DMSO and 8% human serum albumin, or culture media containing 10% Dextran 40 and 5% Dextrose, 20% Human Serum Albumin and 7.5% DMSO, or 31.25% Plasmalyte-A, 31.25% Dextrose 5%, 0.45% NaCl, 10% Dextran 40 and 5% Dextrose, 20% Human Serum Albumin, and 7.5% DMSO or other suitable cell freezing media containing for example, Hespan and PlasmaLyte A, the cells then are frozen to −80° C. at a rate of 1° per minute and stored in the vapor phase of a liquid nitrogen storage tank. Other methods of controlled freezing may be used as well as uncontrolled freezing immediately at −20° C. or in liquid nitrogen.

In certain aspects, cryopreserved cells are thawed and washed as described herein and allowed to rest for one hour at room temperature prior to activation using the methods of the present invention.

Also contemplated in the context of the invention is the collection of blood samples or apheresis product from a subject at a time period prior to when the expanded cells as described herein might be needed. As such, the source of the cells to be expanded can be collected at any time point necessary, and desired cells, such as T cells, isolated and frozen for later use in immune effector cell therapy for any number of diseases or conditions that would benefit from immune effector cell therapy, such as those described herein. In one aspect a blood sample or an apheresis is taken from a generally healthy subject. In certain aspects, a blood sample or an apheresis is taken from a generally healthy subject who is at risk of developing a disease, but who has not yet developed a disease, and the cells of interest are isolated and frozen for later use. In certain aspects, the T cells may be expanded, frozen, and used at a later time. In certain aspects, samples are collected from a patient shortly after diagnosis of a particular disease as described herein but prior to any treatments. In a further aspect, the cells are isolated from a blood sample or an apheresis from a subject prior to any number of relevant treatment modalities, including but not limited to treatment with agents such as natalizumab, efalizumab, antiviral agents, chemotherapy, radiation, immunosuppressive agents, such as cyclosporin, azathioprine, methotrexate, mycophenolate, and FK506, antibodies, or other immunoablative agents such as CAMPATH, anti-CD3 antibodies, cytoxan, fludarabine, cyclosporin, FK506, rapamycin, mycophenolic acid, steroids, FR901228, and irradiation.

In a further aspect of the present invention, T cells are obtained from a patient directly following treatment that leaves the subject with functional T cells. In this regard, it has been observed that following certain cancer treatments, in particular treatments with drugs that damage the immune system, shortly after treatment during the period when patients would normally be recovering from the treatment, the quality of T cells obtained may be optimal or improved for their ability to expand ex vivo. Likewise, following ex vivo manipulation using the methods described herein, these cells may be in a preferred state for enhanced engraftment and in vivo expansion. Thus, it is contemplated within the context of the present invention to collect blood cells, including T cells, dendritic cells, or other cells of the hematopoietic lineage, during this recovery phase. Further, in certain aspects, mobilization (for example, mobilization with GM-CSF) and conditioning regimens can be used to create a condition in a subject wherein repopulation, recirculation, regeneration, and/or expansion of particular cell types is favored, especially during a defined window of time following therapy. Illustrative cell types include T cells, B cells, dendritic cells, and other cells of the immune system.

In one embodiment, the immune effector cells expressing a CAR molecule, e.g., a CAR molecule described herein, are obtained from a subject that has received a low, immune enhancing dose of an mTOR inhibitor. In an embodiment, the population of immune effector cells, e.g., T cells, to be engineered to express a CAR, are harvested after a sufficient time, or after sufficient dosing of the low, immune enhancing, dose of an mTOR inhibitor, such that the level of PD1 negative immune effector cells, e.g., T cells, or the ratio of PD1 negative immune effector cells, e.g., T cells/PD1 positive immune effector cells, e.g., T cells, in the subject or harvested from the subject has been, at least transiently, increased.

In other embodiments, population of immune effector cells, e.g., T cells, which have, or will be engineered to express a CAR, can be treated ex vivo by contact with an amount of an mTOR inhibitor that increases the number of PD1 negative immune effector cells, e.g., T cells or increases the ratio of PD1 negative immune effector cells, e.g., T cells/PD1 positive immune effector cells, e.g., T cells.

In one embodiment, a T cell population is diacylglycerol kinase (DGK)-deficient. DGK-deficient cells include cells that do not express DGK RNA or protein, or have reduced or inhibited DGK activity. DGK-deficient cells can be generated by genetic approaches, e.g., administering RNA-interfering agents, e.g., siRNA, shRNA, miRNA, to reduce or prevent DGK expression. Alternatively, DGK-deficient cells can be generated by treatment with DGK inhibitors described herein.

In one embodiment, a T cell population is Ikaros-deficient. Ikaros-deficient cells include cells that do not express Ikaros RNA or protein, or have reduced or inhibited Ikaros activity. Ikaros-deficient cells can be generated by genetic approaches, e.g., administering RNA-interfering agents, e.g., siRNA, shRNA, miRNA, to reduce or prevent Ikaros expression. Alternatively, Ikaros-deficient cells can be generated by treatment with Ikaros inhibitors, e.g., lenalidomide.

In embodiments, a T cell population is DGK-deficient and Ikaros-deficient, e.g., does not express DGK and Ikaros, or has reduced or inhibited DGK and Ikaros activity. Such DGK and Ikaros-deficient cells can be generated by any of the methods described herein.

In an embodiment, the NK cells are obtained from the subject. In another embodiment, the NK cells are an NK cell line, e.g., NK-92 cell line (Conkwest).

Allogeneic CAR

In embodiments described herein, the immune effector cell can be an allogeneic immune effector cell, e.g., T cell or NK cell. For example, the cell can be an allogeneic T cell, e.g., an allogeneic T cell lacking expression of a functional T cell receptor (TCR) and/or human leukocyte antigen (HLA), e.g., HLA class I and/or HLA class II.

A T cell lacking a functional TCR can be, e.g., engineered such that it does not express any functional TCR on its surface, engineered such that it does not express one or more subunits that comprise a functional TCR (e.g., engineered such that it does not express (or exhibits reduced expression) of TCR alpha, TCR beta, TCR gamma, TCR delta, TCR epsilon, and/or TCR zeta) or engineered such that it produces very little functional TCR on its surface (e.g., engineered such that it does not express (or exhibits reduced expression) of TCR alpha, TCR beta, TCR gamma, TCR delta, TCR epsilon, and/or TCR zeta). Alternatively, the T cell can express a substantially impaired TCR, e.g., by expression of mutated or truncated forms of one or more of the subunits of the TCR. The term "substantially impaired TCR" means that this TCR will not elicit an adverse immune reaction in a host.

A T cell described herein can be, e.g., engineered such that it does not express a functional HLA on its surface. For example, a T cell described herein, can be engineered such that cell surface expression HLA, e.g., HLA class 1 and/or HLA class II, is downregulated. In some embodiments, downregulation of HLA may be accomplished by reducing or eliminating expression of beta-2 microglobulin (B2M).

In some embodiments, the T cell can lack a functional TCR and a functional HLA, e.g., HLA class I and/or HLA class II.

Modified T cells that lack expression of a functional TCR and/or HLA can be obtained by any suitable means, including a knock out or knock down of one or more subunit of TCR or HLA. For example, the T cell can include a knock down of TCR and/or HLA using siRNA, shRNA, clustered regularly interspaced short palindromic repeats (CRISPR) transcription-activator like effector nuclease (TALEN), or zinc finger endonuclease (ZFN).

In some embodiments, the allogeneic cell can be a cell which does not express or expresses at low levels an inhibitory molecule, e.g. a cell engineered by any method described herein. For example, the cell can be a cell that does not express or expresses at low levels an inhibitory molecule, e.g., that can decrease the ability of a CAR-expressing cell to mount an immune effector response. Examples of inhibitory molecules include PD1, PD-L1, PD-L2, CTLA4, TIM3, CEACAM (e.g., CEACAM-1, CEACAM-3 and/or CEACAM-5), LAGS, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GALS, adenosine, and TGFR (e.g., TGFR beta). Inhibition of an inhibitory molecule, e.g., by inhibition at the DNA, RNA or protein level, can optimize a CAR-expressing cell performance. In embodiments, an inhibitory nucleic acid, e.g., an inhibitory nucleic acid, e.g., a dsRNA, e.g., an siRNA or shRNA, a clustered regularly interspaced short palindromic repeats (CRISPR), a transcription-activator like effector nuclease (TALEN), or a zinc finger endonuclease (ZFN), e.g., as described herein, can be used.

siRNA and shRNA to Inhibit TCR or HLA

In some embodiments, TCR expression and/or HLA expression can be inhibited using siRNA or shRNA that targets a nucleic acid encoding a TCR and/or HLA, and/or an inhibitory molecule described herein (e.g., PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGFR beta), in a T cell.

Expression systems for siRNA and shRNAs, and exemplary shRNAs, are described, e.g., in paragraphs 649 and 650 of International Application WO2015/142675, filed Mar. 13, 2015, which is incorporated by reference in its entirety.

CRISPR to Inhibit TCR or HLA

"CRISPR" or "CRISPR to TCR and/or HLA" or "CRISPR to inhibit TCR and/or HLA" as used herein refers to a set of clustered regularly interspaced short palindromic repeats, or a system comprising such a set of repeats. "Cas", as used herein, refers to a CRISPR-associated protein. A "CRISPR/Cas" system refers to a system derived from CRISPR and Cas which can be used to silence or mutate a TCR and/or HLA gene, and/or an inhibitory molecule described herein (e.g., PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGFR beta).

The CRISPR/Cas system, and uses thereof, are described, e.g., in paragraphs 651-658 of International Application WO2015/142675, filed Mar. 13, 2015, which is incorporated by reference in its entirety.

TALEN to Inhibit TCR and/or HLA

"TALEN" or "TALEN to HLA and/or TCR" or "TALEN to inhibit HLA and/or TCR" refers to a transcription activator-like effector nuclease, an artificial nuclease which can be used to edit the HLA and/or TCR gene, and/or an inhibitory molecule described herein (e.g., PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGFR beta).

TALENs, TALEs, and uses thereof, are described, e.g., in paragraphs 659-665 of International Application WO2015/142675, filed Mar. 13, 2015, which is incorporated by reference in its entirety.

Zinc Finger Nuclease to Inhibit HLA and/or TCR

"ZFN" or "Zinc Finger Nuclease" or "ZFN to HLA and/or TCR" or "ZFN to inhibit HLA and/or TCR" refer to a zinc finger nuclease, an artificial nuclease which can be used to edit the HLA and/or TCR gene, and/or an inhibitory molecule described herein (e.g., PD1, PD-L1, PD-L2, CTLA4, TIM3, CEACAM (e.g., CEACAM-1, CEACAM-3 and/or CEACAM-5), LAGS, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GALS, adenosine, and TGFR beta).

ZFNs, and uses thereof, are described, e.g., in paragraphs 666-671 of International Application WO2015/142675, filed Mar. 13, 2015, which is incorporated by reference in its entirety.

Telomerase Expression

While not wishing to be bound by any particular theory, in some embodiments, a therapeutic T cell has short term persistence in a patient, due to shortened telomeres in the T cell; accordingly, transfection with a telomerase gene can lengthen the telomeres of the T cell and improve persistence of the T cell in the patient. See Carl June, "Adoptive T cell therapy for cancer in the clinic", Journal of Clinical Investigation, 117:1466-1476 (2007). Thus, in an embodiment, an immune effector cell, e.g., a T cell, ectopically expresses a telomerase subunit, e.g., the catalytic subunit of telomerase, e.g., TERT, e.g., hTERT. In some aspects, this disclosure provides a method of producing a CAR-expressing cell, comprising contacting a cell with a nucleic acid encoding a telomerase subunit, e.g., the catalytic subunit of telomerase, e.g., TERT, e.g., hTERT. The cell may be contacted with the nucleic acid before, simultaneous with, or after being contacted with a construct encoding a CAR.

In one aspect, the disclosure features a method of making a population of immune effector cells (e.g., T cells or NK cells). In an embodiment, the method comprises: providing a population of immune effector cells (e.g., T cells or NK cells), contacting the population of immune effector cells with a nucleic acid encoding a CAR; and contacting the population of immune effector cells with a nucleic acid encoding a telomerase subunit, e.g., hTERT, under conditions that allow for CAR and telomerase expression.

In an embodiment, the nucleic acid encoding the telomerase subunit is DNA. In an embodiment, the nucleic acid encoding the telomerase subunit comprises a promoter capable of driving expression of the telomerase subunit.

In an embodiment, hTERT has the amino acid sequence of GenBank Protein ID AAC51724.1 (Meyerson et al., "hEST2, the Putative Human Telomerase Catalytic Subunit Gene, Is Up-Regulated in Tumor Cells and during Immortalization" Cell Volume 90, Issue 4, 22 Aug. 1997, Pages 785-795) as follows:

(SEQ ID NO: 1332)
MPRAPRCRAVRSLLRSHYREVLPLATFVRRLGPQGWRLVQRGDPAAFRAL

VAQCLVCVPWDARPPPAAPSFRQVSCLKELVARVLQRLCERGAKNVLAFG

FALLDGARGGPPEAFTTSVRSYLPNTVTDALRGSGAWGLLLRRVGDDVLV

HLLARCALFVLVAPSCAYQVCGPPLYQLGAATQARPPPHASGPRRRLGCE

RAWNHSVREAGVPLGLPAPGARRRGGSASRSLPLPKRPRRGAAPEPERTP

VGQGSWAHPGRTRGPSDRGFCVVSPARPAEEATSLEGALSGTRHSHPSVG

RQHHAGPPSTSRPPRPWDTPCPPVYAETKHFLYSSGDKEQLRPSFLLSSL

RPSLTGARRLVETIFLGSRPWMPGTPRRLPRLPQRYWQMRPLFLELLGNH

AQCPYGVLLKTHCPLRAAVTPAAGVCAREKPQGSVAAPEEEDTDPRRLVQ

LLRQHSSPWQVYGFVRACLRRLVPPGLWGSRHNERRFLRNTKKFISLGKH

AKLSLQELTWKMSVRGCAWLRRSPGVGCVPAAEHRLREEILAKFLHWLMS

VYVVELLRSFFYVTETTFQKNRLFFYRKSVWSKLQSIGIRQHLKRVQLRE

LSEAEVRQHREARPALLTSRLRFIPKPDGLRPIVNMDYVVGARTFRREKR

AERLTSRVKALFSVLNYERARRPGLLGASVLGLDDIHRAWRTFVLRVRAQ

DPPPELYFVKVDVTGAYDTIPQDRLTEVIASIIKPQNTYCVRRYAVVQKA

AHGHVRKAFKSHVSTLTDLQPYMRQFVAHLQETSPLRDAVVIEQSSSLNE

ASSGLFDVFLRFMCHHAVRIRGKSYVQCQGIPQGSILSTLLCSLCYGDME

NKLFAGIRRDGLLLRLVDDFLLVTPHLTHAKTFLRTLVRGVPEYGCVVNL

RKTVVNFPVEDEALGGTAFVQMPAHGLFPWCGLLLDTRTLEVQSDYSSYA

RTSIRASLTFNRGFKAGRNMRRKLFGVLRLKCHSLFLDLQVNSLQTVCTN

IYKILLLQAYRFHACVLQLPFHQQVWKNPTFFLRVISDTASLCYSILKAK

NAGMSLGAKGAAGPLPSEAVQWLCHQAFLLKLTRHRVTYVPLLGSLRTAQ

TQLSRKLPGTTLTALEAAANPALPSDFKTILD

In an embodiment, the hTERT has a sequence at least 80%, 85%, 90%, 95%, 96^, 97%, 98%, or 99% identical to the sequence of SEQ ID NO: 1332. In an embodiment, the hTERT has a sequence of SEQ ID NO: 1332. In an embodiment, the hTERT comprises a deletion (e.g., of no more than 5, 10, 15, 20, or 30 amino acids) at the N-terminus, the C-terminus, or both. In an embodiment, the hTERT comprises a transgenic amino acid sequence (e.g., of no more than 5, 10, 15, 20, or 30 amino acids) at the N-terminus, the C-terminus, or both.

In an embodiment, the hTERT is encoded by the nucleic acid sequence of GenBank Accession No. AF018167 (Meyerson et al., "hEST2, the Putative Human Telomerase Catalytic Subunit Gene, Is Up-Regulated in Tumor Cells and during Immortalization" Cell Volume 90, Issue 4, 22 Aug. 1997, Pages 785-795):

```
                                                          (SEQ ID NO: 1333)
   1 caggcagcgt ggtcctgctg cgcacgtggg aagccctggc cccggccacc cccgcgatgc
  61 cgcgcgctcc ccgctgccga gccgtgcgct ccctgctgcg cagccactac cgcgaggtgc
 121 tgccgctggc cacgttcgtg cggcgcctgg ggccccaggg ctggcggctg gtgcagcgcg
 181 gggacccggc ggctttccgc gcgctggtgg cccagtgcct ggtgtgcgtg ccctgggacg
 241 cacggccgcc ccccgccgcc cctccttcc gccaggtgtc ctgcctgaag gagctggtgg
 301 cccgagtgct gcagaggctg tgcgagcgcg gcgcgaagaa cgtgctggcc ttcggcttcg
 361 cgctgctgga cggggcccgc gggggccccc ccgaggcctt caccaccagc gtgcgcagct
 421 acctgcccaa cacggtgacc gacgcactgc gggggagcgg ggcgtggggg ctgctgttgc
 481 gccgcgtggg cgacgacgtg ctggttcacc tgctggcacg ctgcgcgctc tttgtgctgg
 541 tggctcccag ctgcgcctac caggtgtgcg ggccgccgct gtaccagctc ggcgctgcca
 601 ctcaggcccg gccccgcca cacgctagtg gaccccgaag gcgtctggga tgcgaacggg
 661 cctggaacca tagcgtcagg gaggccgggg tcccctggg cctgccagcc ccgggtgcga
 721 ggaggcgcgg gggcagtgcc agccgaagtc tgccgttgcc caagaggccc aggcgtggcg
 781 ctgcccctga gccggagcgg acgcccgttg gcaggggtc ctgggcccac ccgggcagga
 841 cgcgtggacc gagtgaccgt ggtttctgtg tggtgtcacc tgccagaccc gccgaagaag
 901 ccacctcttt ggagggtgcg ctctctggca cgcgccactc ccacccatcc gtgggccgcc
 961 agcaccacgc gggccccca tccacatcgc ggccaccacg tccctgggac acgccttgtc
1021 ccccggtgta cgccgagacc aagcacttcc tctactcctc aggcgacaag gagcagctgc
1081 ggccctcctt cctactcagc tctctgagcc ccagcctgac tggcgctcgg aggctcgtgg
1141 agaccatctt tctgggttcc aggccctgga tgccagggac tccccgcagg ttgccccgcc
```

```
1201 tgccccagcg ctactggcaa atgcggcccc tgtttctgga gctgcttggg aaccacgcgc 1261 agtgcccta cggggtgctc ctcaagacgc actgcccgct gcgagctgcg gtcaccccag 1321 cagccggtgt ctgtgcccgg gagaagcccc agggctctgt ggcggccccc gaggaggagg 1381 acacagaccc ccgtcgcctg gtgcagctgc tccgccagca cagcagcccc tggcaggtgt 1441 acggcttcgt gcgggcctgc ctgcgccggc tggtgccccc aggcctctgg ggctccaggc 1501 acaacgaacg ccgcttcctc aggaacacca agaagttcat ctccctgggg aagcatgcca 1561 agctctcgct gcaggagctg acgtggaaga tgagcgtgcg gggctgcgct tggctgcgca 1621 ggagcccagg ggttggctgt gttccggccg cagagcaccg tctgcgtgag gagatcctgg 1681 ccaagttcct gcactggctg atgagtgtgt acgtcgtcga gctgctcagg tctttctttt 1741 atgtcacgga gaccacgttt caaaagaaca ggctcttttt ctaccggaag agtgtctgga 1801 gcaagttgca aagcattgga atcagacagc acttgaagag ggtgcagctg cgggagctgt 1861 cggaagcaga ggtcaggcag catcgggaag ccaggcccgc cctgctgacg tccagactcc 1921 gcttcatccc caagcctgac gggctgcggc cgattgtgaa catggactac gtcgtgggag 1981 ccagaacgtt ccgcagagaa aagagggccg agcgtctcac ctcgagggtg aaggcactgt 2041 tcagcgtgct caactacgag cgggcgcggc gccccggcct cctgggcgcc tctgtgctgg 2101 gcctggacga tatccacagg gcctggcgca ccttcgtgct gcgtgtgcgg gcccaggacc 2161 cgccgcctga gctgtacttt gtcaaggtgg atgtgacggg cgcgtacgac accatccccc 2221 aggacaggct cacggaggtc atcgccagca tcatcaaacc ccagaacacg tactgcgtgc 2281 gtcggtatgc cgtggtccag aaggccgccc atgggcacgt ccgcaaggcc ttcaagagcc 2341 acgtctctac cttgacagac ctccagccgt acatgcgaca gttcgtggct cacctgcagg 2401 agaccagccc gctgagggat gccgtcgtca tcgagcagag ctcctcctg aatgaggcca 2461 gcagtggcct cttcgacgtc ttcctacgct tcatgtgcca ccacgccgtg cgcatcaggg 2521 gcaagtccta cgtccagtgc cagggatcc cgcagggctc catcctctcc acgctgctct 2581 gcagcctgtg ctacggcgac atggagaaca agctgtttgc ggggattcgg cgggacgggc 2641 tgctcctgcg tttggtggat gatttcttgt tggtgacacc tcacctcacc cacgcgaaaa 2701 ccttcctcag gaccctggtc cgaggtgtcc ctgagtatgg ctgcgtggtg aacttgcgga 2761 agacagtggt gaacttccct gtagaagacg aggccctggg tggcacggct tttgttcaga 2821 tgccggccca cggcctattc ccctggtgcg gcctgctgct ggatacccgg accctggagg 2881 tgcagagcga ctactccagc tatgcccgga cctccatcag agccagtctc accttcaacc 2941 gcggcttcaa ggctgggagg aacatgcgtc gcaaactctt tggggtcttg cggctgaagt 3001 gtcacagcct gtttctggat ttgcaggtga acagcctcca gacggtgtgc accaacatct 3061 acaagatcct cctgctgcag gcgtacaggt ttcacgcatg tgtgctgcag ctcccatttc 3121 atcagcaagt ttggaagaac cccacatttt tcctgcgcgt catctctgac acggcctccc 3181 tctgctactc catcctgaaa gccaagaacg cagggatgtc gctgggggcc aagggcgccg 3241 ccggccctct gccctccgag gccgtgcagt ggctgtgcca ccaagcattc ctgctcaagc 3301 tgactcgaca ccgtgtcacc tacgtgccac tcctggggtc actcaggaca gcccagacgc 3361 agctgagtcg gaagctcccg ggacgacgc tgactgccct ggaggccgca gccaacccgg 3421 cactgcctc agacttcaag accatcctgg actgatggcc acccgccac agccaggccg 3481 agagcagaca ccagcagccc tgtcacgccg ggctctacgt cccagggagg gaggggcggc 3541 ccacacccag gcccgcaccg ctgggagtct gaggcctgag tgagtgtttg gccgaggcct 3601 gcatgtccgg ctgaaggctg agtgtccggc tgaggcctga gcgagtgtcc agccaagggc
```

```
3661 tgagtgtcca gcacacctgc cgtcttcact tccccacagg ctggcgctcg gctccacccc 3721 agggccagct tttcctcacc aggagcccgg cttccactcc ccacatagga atagtccatc 3781 cccagattcg ccattgttca cccctcgccc tgccctcctt tgccttccac ccccaccatc 3841 caggtggaga ccctgagaag gaccctggga gctctgggaa tttggagtga ccaaaggtgt 3901 gccctgtaca caggcgagga ccctgcacct ggatgggggt ccctgtgggt caaattgggg 3961 ggaggtgctg tgggagtaaa atactgaata tatgagtttt tcagttttga aaaaaaaaa 4021 aaaaaaa
```

In an embodiment, the hTERT is encoded by a nucleic acid having a sequence at least 80%, 85%, 90%, 95%, 96, 97%, 98%, or 99% identical to the sequence of SEQ ID NO: 1333. In an embodiment, the hTERT is encoded by a nucleic acid of SEQ ID NO: 1333.

Activation and Expansion of Immune Effector Cells (e.g., T Cells)

Immune effector cells such as T cells may be activated and expanded generally using methods as described, for example, in U.S. Pat. Nos. 6,352,694; 6,534,055; 6,905,680; 6,692,964; 5,858,358; 6,887,466; 6,905,681; 7,144,575; 7,067,318; 7,172,869; 7,232,566; 7,175,843; 5,883,223; 6,905,874; 6,797,514; 6,867,041; and U.S. Patent Application Publication No. 20060121005.

The procedure for ex vivo expansion of hematopoietic stem and progenitor cells is described in U.S. Pat. No. 5,199,942, incorporated herein by reference, can be applied to the cells of the present invention. Other suitable methods are known in the art, therefore the present invention is not limited to any particular method of ex vivo expansion of the cells. Briefly, ex vivo culture and expansion of T cells can comprise: (1) collecting CD34+ hematopoietic stem and progenitor cells from a mammal from peripheral blood harvest or bone marrow explants; and (2) expanding such cells ex vivo. In addition to the cellular growth factors described in U.S. Pat. No. 5,199,942, other factors such as flt3-L, IL-1, IL-3 and c-kit ligand, can be used for culturing and expansion of the cells.

Generally, a population of immune effector cells may be expanded by contact with a surface having attached thereto an agent that stimulates a CD3/TCR complex associated signal and a ligand that stimulates a costimulatory molecule on the surface of the T cells. In particular, T cell populations may be stimulated as described herein, such as by contact with an anti-CD3 antibody, or antigen-binding fragment thereof, or an anti-CD2 antibody immobilized on a surface, or by contact with a protein kinase C activator (e.g., bryostatin) in conjunction with a calcium ionophore. For co-stimulation of an accessory molecule on the surface of the T cells, a ligand that binds the accessory molecule is used. For example, a population of T cells can be contacted with an anti-CD3 antibody and an anti-CD28 antibody, under conditions appropriate for stimulating proliferation of the T cells. To stimulate proliferation of either CD4+ T cells or CD8+ T cells, an anti-CD3 antibody and an anti-CD28 antibody may be used. Examples of an anti-CD28 antibody include 9.3, B-T3, XR-CD28 (Diaclone, Besancon, France) can be used as can other methods commonly known in the art (Berg et al., Transplant Proc. 30(8):3975-3977, 1998; Haanen et al., J. Exp. Med. 190(9):13191328, 1999; Garland et al., J. Immunol Meth. 227(1-2):53-63, 1999).

In some embodiments, immune effector cells (such as PBMCs or T cells) are expanded and stimulated by contacting the cells to one or both of an anti-CD3 antibody and IL-2. In embodiments, the cells are expanded without anti-CD3 or anti-CD28 beads.

In certain aspects, the primary stimulatory signal and the costimulatory signal for the T cell may be provided by different protocols. For example, the agents providing each signal may be in solution or coupled to a surface. When coupled to a surface, the agents may be coupled to the same surface (i.e., in "cis" formation) or to separate surfaces (i.e., in "trans" formation). Alternatively, one agent may be coupled to a surface and the other agent in solution. In one aspect, the agent providing the costimulatory signal is bound to a cell surface and the agent providing the primary activation signal is in solution or coupled to a surface. In certain aspects, both agents can be in solution. In one aspect, the agents may be in soluble form, and then cross-linked to a surface, such as a cell expressing Fc receptors or an antibody or other binding agent which will bind to the agents. In this regard, see for example, U.S. Patent Application Publication Nos. 20040101519 and 20060034810 for artificial antigen presenting cells (aAPCs) that are contemplated for use in activating and expanding T cells in the present invention.

In one aspect, the two agents are immobilized on beads, either on the same bead, i.e., "cis," or to separate beads, i.e., "trans." By way of example, the agent providing the primary activation signal is an anti-CD3 antibody or an antigen-binding fragment thereof and the agent providing the costimulatory signal is an anti-CD28 antibody or antigen-binding fragment thereof; and both agents are co-immobilized to the same bead in equivalent molecular amounts. In one aspect, a 1:1 ratio of each antibody bound to the beads for CD4+ T cell expansion and T cell growth is used. In certain aspects, a ratio of anti CD3:CD28 antibodies bound to the beads is used such that an increase in T cell expansion is observed as compared to the expansion observed using a ratio of 1:1. In one particular aspect an increase of from about 1 to about 3 fold is observed as compared to the expansion observed using a ratio of 1:1. In one aspect, the ratio of CD3:CD28 antibody bound to the beads ranges from 100:1 to 1:100 and all integer values there between. In one aspect, more anti-CD28 antibody is bound to the particles than anti-CD3 antibody, i.e., the ratio of CD3:CD28 is less than one. In certain aspects, the ratio of anti CD28 antibody to anti CD3 antibody bound to the beads is greater than 2:1. In one particular aspect, a 1:100 CD3:CD28 ratio of antibody bound to beads is used. In one aspect, a 1:75 CD3:CD28 ratio of antibody bound to beads is used. In a further aspect, a 1:50 CD3:CD28 ratio of antibody bound to beads is used. In one aspect, a 1:30 CD3:CD28 ratio of antibody bound to beads is used. In one aspect, a 1:10 CD3:CD28 ratio of antibody bound to beads is used. In one aspect, a 1:3

CD3:CD28 ratio of antibody bound to the beads is used. In yet one aspect, a 3:1 CD3:CD28 ratio of antibody bound to the beads is used.

Ratios of particles to cells from 1:500 to 500:1 and any integer values in between may be used to stimulate T cells or other target cells. As those of ordinary skill in the art can readily appreciate, the ratio of particles to cells may depend on particle size relative to the target cell. For example, small sized beads could only bind a few cells, while larger beads could bind many. In certain aspects the ratio of cells to particles ranges from 1:100 to 100:1 and any integer values in-between and in further aspects the ratio comprises 1:9 to 9:1 and any integer values in between, can also be used to stimulate T cells. The ratio of anti-CD3- and anti-CD28-coupled particles to T cells that result in T cell stimulation can vary as noted above, however certain suitable values include 1:100, 1:50, 1:40, 1:30, 1:20, 1:10, 1:9, 1:8, 1:7, 1:6, 1:5, 1:4, 1:3, 1:2, 1:1, 2:1, 3:1, 4:1, 5:1, 6:1, 7:1, 8:1, 9:1, 10:1, and 15:1 with one suitable ratio being at least 1:1 particles per T cell. In one aspect, a ratio of particles to cells of 1:1 or less is used. In one particular aspect, a suitable particle: cell ratio is 1:5. In further aspects, the ratio of particles to cells can be varied depending on the day of stimulation. For example, in one aspect, the ratio of particles to cells is from 1:1 to 10:1 on the first day and additional particles are added to the cells every day or every other day thereafter for up to 10 days, at final ratios of from 1:1 to 1:10 (based on cell counts on the day of addition). In one particular aspect, the ratio of particles to cells is 1:1 on the first day of stimulation and adjusted to 1:5 on the third and fifth days of stimulation. In one aspect, particles are added on a daily or every other day basis to a final ratio of 1:1 on the first day, and 1:5 on the third and fifth days of stimulation. In one aspect, the ratio of particles to cells is 2:1 on the first day of stimulation and adjusted to 1:10 on the third and fifth days of stimulation. In one aspect, particles are added on a daily or every other day basis to a final ratio of 1:1 on the first day, and 1:10 on the third and fifth days of stimulation. One of skill in the art will appreciate that a variety of other ratios may be suitable for use in the present invention. In particular, ratios will vary depending on particle size and on cell size and type. In one aspect, the most typical ratios for use are in the neighborhood of 1:1, 2:1 and 3:1 on the first day.

In further aspects of the present invention, the cells, such as T cells, are combined with agent-coated beads, the beads and the cells are subsequently separated, and then the cells are cultured. In an alternative aspect, prior to culture, the agent-coated beads and cells are not separated but are cultured together. In a further aspect, the beads and cells are first concentrated by application of a force, such as a magnetic force, resulting in increased ligation of cell surface markers, thereby inducing cell stimulation.

By way of example, cell surface proteins may be ligated by allowing paramagnetic beads to which anti-CD3 and anti-CD28 are attached (3×28 beads) to contact the T cells. In one aspect the cells (for example, $10^4$ to $10^9$ T cells) and beads (for example, DYNABEADS® M-450 CD3/CD28 T paramagnetic beads at a ratio of 1:1) are combined in a buffer, for example PBS (without divalent cations such as, calcium and magnesium). Again, those of ordinary skill in the art can readily appreciate any cell concentration may be used. For example, the target cell may be very rare in the sample and comprise only 0.01% of the sample or the entire sample (i.e., 100%) may comprise the target cell of interest. Accordingly, any cell number is within the context of the present invention. In certain aspects, it may be desirable to significantly decrease the volume in which particles and cells are mixed together (i.e., increase the concentration of cells), to ensure maximum contact of cells and particles. For example, in one aspect, a concentration of about 10 billion cells/ml, 9 billion/ml, 8 billion/ml, 7 billion/ml, 6 billion/ml, or 5 billion/ml or 2 billion cells/ml is used. In one aspect, greater than 100 million cells/ml is used. In a further aspect, a concentration of cells of 10, 15, 20, 25, 30, 35, 40, 45, or 50 million cells/ml is used. In yet one aspect, a concentration of cells from 75, 80, 85, 90, 95, or 100 million cells/ml is used. In further aspects, concentrations of 125 or 150 million cells/ml can be used. Using high concentrations can result in increased cell yield, cell activation, and cell expansion. Further, use of high cell concentrations allows more efficient capture of cells that may weakly express target antigens of interest, such as CD28-negative T cells. Such populations of cells may have therapeutic value and would be desirable to obtain in certain aspects. For example, using high concentration of cells allows more efficient selection of CD8+ T cells that normally have weaker CD28 expression.

In one embodiment, cells transduced with a nucleic acid encoding a CAR, e.g., a CAR described herein, are expanded, e.g., by a method described herein. In one embodiment, the cells are expanded in culture for a period of several hours (e.g., about 2, 3, 4, 5, 6, 7, 8, 9, 10, 15, 18, 21 hours) to about 14 days (e.g., 1, 2, 3, 4, 5, 6, 7, 8, 9, 10, 11, 12, 13 or 14 days). In one embodiment, the cells are expanded for a period of 4 to 9 days. In one embodiment, the cells are expanded for a period of 8 days or less, e.g., 7, 6 or 5 days. In one embodiment, the cells, e.g., a CAR cell described herein, are expanded in culture for 5 days, and the resulting cells are more potent than the same cells expanded in culture for 9 days under the same culture conditions. Potency can be defined, e.g., by various T cell functions, e.g. proliferation, target cell killing, cytokine production, activation, migration, or combinations thereof. In one embodiment, the cells, e.g., a CD19 CAR cell described herein, expanded for 5 days show at least a one, two, three or four fold increase in cells doublings upon antigen stimulation as compared to the same cells expanded in culture for 9 days under the same culture conditions. In one embodiment, the cells, e.g., the cells expressing a CAR described herein, are expanded in culture for 5 days, and the resulting cells exhibit higher proinflammatory cytokine production, e.g., IFN-γ and/or GM-CSF levels, as compared to the same cells expanded in culture for 9 days under the same culture conditions. In one embodiment, the cells, e.g., a CAR cell described herein, expanded for 5 days show at least a one, two, three, four, five, ten fold or more increase in pg/ml of proinflammatory cytokine production, e.g., IFN-γ and/or GM-CSF levels, as compared to the same cells expanded in culture for 9 days under the same culture conditions.

In one aspect of the present invention, the mixture may be cultured for several hours (about 3 hours) to about 14 days or any hourly integer value in between. In one aspect, the mixture may be cultured for 21 days. In one aspect of the invention the beads and the T cells are cultured together for about eight days. In one aspect, the beads and T cells are cultured together for 2-3 days.

Several cycles of stimulation may also be desired such that culture time of T cells can be 60 days or more. Conditions appropriate for T cell culture include an appropriate media (e.g., Minimal Essential Media or RPMI Media 1640 or, X-vivo 15, (Lonza)) that may contain factors necessary for proliferation and viability, including serum (e.g., fetal bovine or human serum), interleukin-2 (IL-2), insulin, IFN-γ, IL-4, IL-7, GM-CSF, IL-10, IL-12, IL-15, TGFβ, and TNF-α or any other additives for the growth of cells known to the skilled artisan. Other additives for the growth of cells include, but are not limited to, surfactant, plasmanate, and reducing agents such as N-acetyl-cysteine and 2-mercaptoethanol. Media can include RPMI 1640, AIM-V, DMEM, MEM, α-MEM, F-12, X-Vivo 15, and X-Vivo 20, Optimizer, with added amino acids, sodium pyruvate, and vitamins, either serum-free or supplemented with an appropriate amount of serum (or plasma) or a defined set of hormones, and/or an amount of cytokine(s) sufficient for the growth and expansion of T cells. Antibiotics, e.g., penicillin and streptomycin, are included only in experimental cultures, not in cultures of cells that are to be infused into a subject. The target cells are maintained under conditions necessary to support growth, for example, an appropriate temperature (e.g., 37° C.) and atmosphere (e.g., air plus 5% $CO_2$).

In one embodiment, the cells are expanded in an appropriate media (e.g., media described herein) that includes one or more interleukin that result in at least a 200-fold (e.g., 200-fold, 250-fold, 300-fold, 350-fold) increase in cells over a 14 day expansion period, e.g., as measured by a method described herein such as flow cytometry. In one embodiment, the cells are expanded in the presence IL-15 and/or IL-7 (e.g., IL-15 and IL-7).

In some embodiments a CAR-expressing cell described herein (e.g., a T cell such as a CD4+ T cell or a CD8+ T cell) is contacted with a composition comprising a interleukin-15 (IL-15) polypeptide, a interleukin-15 receptor alpha (IL-15Ra) polypeptide, or a combination of both a IL-15 polypeptide and a IL-15Ra polypeptide e.g., hetIL-15, during the manufacturing of the CAR-expressing cell, e.g., ex vivo. In embodiments, a CAR-expressing cell described herein is contacted with a composition comprising a IL-15 polypeptide during the manufacturing of the CAR-expressing cell, e.g., ex vivo. In embodiments, a CAR-expressing cell described herein is contacted with a composition comprising a combination of both a IL-15 polypeptide and a IL-15 Ra polypeptide during the manufacturing of the CAR-expressing cell, e.g., ex vivo. In embodiments, a CAR-expressing cell described herein is contacted with a composition comprising hetIL-15 during the manufacturing of the CAR-expressing cell, e.g., ex vivo.

In one embodiment the CAR-expressing cell (e.g., a T cell or NK cell) described herein is contacted with a composition comprising hetIL-15 during ex vivo expansion. In an embodiment, the CAR-expressing cell described herein is contacted with a composition comprising an IL-15 polypeptide during ex vivo expansion. In an embodiment, the CAR-expressing cell described herein is contacted with a composition comprising both an IL-15 polypeptide and an IL-15Ra polypeptide during ex vivo expansion. In one embodiment the contacting results in the survival and proliferation of a lymphocyte subpopulation, e.g., CD8+ T cells.

In an embodiments, the method of making disclosed herein further comprises contacting the population of immune effector cells (e.g., T cells or NK cells) with a nucleic acid encoding a telomerase subunit, e.g., hTERT. The nucleic acid encoding the telomerase subunit can be DNA.

T cells that have been exposed to varied stimulation times may exhibit different characteristics. For example, typical blood or apheresed peripheral blood mononuclear cell products have a helper T cell population (TH, CD4+) that is greater than the cytotoxic or suppressor T cell population (TC, CD8+). Ex vivo expansion of T cells by stimulating CD3 and CD28 receptors produces a population of T cells that prior to about days 8-9 consists predominately of TH cells, while after about days 8-9, the population of T cells comprises an increasingly greater population of TC cells. Accordingly, depending on the purpose of treatment, infusing a subject with a T cell population comprising predominately of TH cells may be advantageous. Similarly, if an antigen-specific subset of TC cells has been isolated it may be beneficial to expand this subset to a greater degree.

Further, in addition to CD4 and CD8 markers, other phenotypic markers vary significantly, but in large part, reproducibly during the course of the cell expansion process. Thus, such reproducibility enables the ability to tailor an activated T cell product for specific purposes.

Once a CAR, e.g., CD19 CAR is constructed, various assays can be used to evaluate the activity of the molecule, such as but not limited to, the ability to expand T cells following antigen stimulation, sustain T cell expansion in the absence of re-stimulation, and anti-cancer activities in appropriate in vitro and animal models. Assays to evaluate the effects of a CAR, e.g., CD19 CAR are described in further detail below.

Western blot analysis of CAR expression in primary T cells can be used to detect the presence of monomers and dimers, e.g., as described in paragraph 695 of International Application WO2015/142675, filed Mar. 13, 2015, which is herein incorporated by reference in its entirety.

In vitro expansion of $CAR^+$ T cells following antigen stimulation can be measured by flow cytometry. For example, a mixture of $CD4^+$ and $CD8^+$ T cells are stimulated with αCD3/αCD28 beads followed by transduction with lentiviral vectors expressing GFP under the control of the promoters to be analyzed. Exemplary promoters include the CMV IE gene, EF-1a, ubiquitin C, or phosphoglycerokinase (PGK) promoters. GFP fluorescence is evaluated on day 6 of culture in the $CD4^+$ and/or $CD8^+$ T cell subsets by flow cytometry. See, e.g., Milone et al., Molecular Therapy 17(8): 1453-1464 (2009). Alternatively, a mixture of $CD4^+$ and $CD8^+$ T cells are stimulated with αCD3/αCD28 coated magnetic beads on day 0, and transduced with CAR on day 1 using a bicistronic lentiviral vector expressing CAR along with eGFP using a 2A ribosomal skipping sequence. Cultures are re-stimulated with either $CD19^+$ K562 cells (K562-CD19), wild-type K562 cells (K562 wild type) or K562 cells expressing hCD32 and 4-1BBL in the presence of anti-CD3 and anti-CD28 antibody (K562-BBL-3/28) following washing. Exogenous IL-2 is added to the cultures every other day at 100 IU/ml. $GFP^+$ T cells are enumerated by flow cytometry using bead-based counting. See, e.g., Milone et al., Molecular Therapy 17(8): 1453-1464 (2009).

Sustained $CAR^P$ T cell expansion in the absence of re-stimulation can also be measured. See, e.g., Milone et al., Molecular Therapy 17(8): 1453-1464 (2009). Briefly, mean T cell volume (fl) is measured on day 8 of culture using a Coulter Multisizer particle counter, a Nexcelom Cellometer Vision, or Millipore Scepter following stimulation with αCD3/αCD28 coated magnetic beads on day 0, and transduction with the indicated CAR on day 1.

Animal models can also be used to measure a CAR-expressing cell activity, e.g., as described in paragraph 698 of International Application WO2015/142675, filed Mar. 13, 2015, which is herein incorporated by reference in its entirety.

Dose dependent CAR treatment response can be evaluated, e.g., as described in paragraph 699 of International Application WO2015/142675, filed Mar. 13, 2015, which is herein incorporated by reference in its entirety. Assessment of cell proliferation and cytokine production has been previously described, e.g., as described in paragraph 700 of International Application WO2015/142675, filed Mar. 13, 2015, which is herein incorporated by reference in its entirety. Cytotoxicity can be assessed by a standard $^{51}$Cr-release assay, e.g., as described in paragraph 701 of International Application WO2015/142675, filed Mar. 13, 2015, which is herein incorporated by reference in its entirety. Imaging technologies can be used to evaluate specific trafficking and proliferation of CARs in tumor-bearing animal models, e.g., as described in paragraph 702 of International Application WO2015/142675, filed Mar. 13, 2015, which is herein incorporated by reference in its entirety.

Other assays, including those described in the Example section herein as well as those that are known in the art can also be used to evaluate the CARs described herein.

Alternatively, or in combination to the methods disclosed herein, methods and compositions for one or more of detection and/or quantification of CAR-expressing cells (e.g., in vitro or in vivo (e.g., clinical monitoring)), immune cell expansion and/or activation, and/or CAR-specific selection, that involve the use of a CAR ligand, are disclosed. In one exemplary embodiment, the CAR ligand is an antibody that binds to the CAR molecule, e.g., binds to the extracellular antigen binding domain of CAR (e.g., an antibody that binds to the antigen binding domain, e.g., an anti-idiotypic antibody; or an antibody that binds to a constant region of the extracellular binding domain). In other embodiments, the CAR ligand is a CAR antigen molecule (e.g., a CAR antigen molecule as described herein).

In one aspect, a method for detecting and/or quantifying CAR-expressing cells is disclosed. For example, the CAR ligand can be used to detect and/or quantify CAR-expressing cells in vitro or in vivo (e.g., clinical monitoring of CAR-expressing cells in a patient, or dosing a patient). The method includes:

providing the CAR ligand (optionally, a labelled CAR ligand, e.g., a CAR ligand that includes a tag, a bead, a radioactive or fluorescent label);

acquiring the CAR-expressing cell (e.g., acquiring a sample containing CAR-expressing cells, such as a manufacturing sample or a clinical sample);

contacting the CAR-expressing cell with the CAR ligand under conditions where binding occurs, thereby detecting the level (e.g., amount) of the CAR-expressing cells present. Binding of the CAR-expressing cell with the CAR ligand can be detected using standard techniques such as FACS, ELISA and the like.

In another aspect, a method of expanding and/or activating cells (e.g., immune effector cells) is disclosed. The method includes:

providing a CAR-expressing cell (e.g., a first CAR-expressing cell or a transiently expressing CAR cell);

contacting said CAR-expressing cell with a CAR ligand, e.g., a CAR ligand as described herein), under conditions where immune cell expansion and/or proliferation occurs, thereby producing the activated and/or expanded cell population.

In certain embodiments, the CAR ligand is present on (e.g., is immobilized or attached to a substrate, e.g., a non-naturally occurring substrate). In some embodiments, the substrate is a non-cellular substrate. The non-cellular substrate can be a solid support chosen from, e.g., a plate (e.g., a microtiter plate), a membrane (e.g., a nitrocellulose membrane), a matrix, a chip or a bead. In embodiments, the CAR ligand is present in the substrate (e.g., on the substrate surface). The CAR ligand can be immobilized, attached, or associated covalently or non-covalently (e.g., cross-linked) to the substrate. In one embodiment, the CAR ligand is attached (e.g., covalently attached) to a bead. In the aforesaid embodiments, the immune cell population can be expanded in vitro or ex vivo. The method can further include culturing the population of immune cells in the presence of the ligand of the CAR molecule, e.g., using any of the methods described herein.

In other embodiments, the method of expanding and/or activating the cells further comprises addition of a second stimulatory molecule, e.g., CD28. For example, the CAR ligand and the second stimulatory molecule can be immobilized to a substrate, e.g., one or more beads, thereby providing increased cell expansion and/or activation.

In other embodiments, a method for selecting or enriching for a CAR expressing cell is provided. The method includes contacting the CAR expressing cell with a CAR ligand as described herein; and selecting the cell on the basis of binding of the CAR ligand.

In yet other embodiments, a method for depleting (e.g., reducing and/or killing) a CAR expressing cell is provided. The method includes contacting the CAR expressing cell with a CAR ligand as described herein; and targeting the cell on the basis of binding of the CAR ligand thereby reducing the number, and/or killing, the CAR-expressing cell. In one embodiment, the CAR ligand is coupled to a toxic agent (e.g., a toxin or a cell ablative drug). In another embodiment, the anti-idiotypic antibody can cause effector cell activity, e.g., ADCC or ADC activities.

Exemplary anti-CAR antibodies that can be used in the methods disclosed herein are described, e.g., in WO 2014/190273 and by Jena et al., "Chimeric Antigen Receptor (CAR)-Specific Monoclonal Antibody to Detect CD19-Specific T cells in Clinical Trials", PLOS March 2013 8:3 e57838, the contents of which are incorporated by reference. In some aspects and embodiments, the compositions and methods herein are optimized for a specific subset of T cells, e.g., as described in US Serial No. PCT/US2015/043219 filed Jul. 31, 2015, the contents of which are incorporated herein by reference in their entirety. In some embodiments, the optimized subsets of T cells display an enhanced persistence compared to a control T cell, e.g., a T cell of a different type (e.g., CD8+ or CD4+) expressing the same construct.

In some embodiments, a CD4+ T cell comprises a CAR described herein, which CAR comprises an intracellular signaling domain suitable for (e.g., optimized for, e.g., leading to enhanced persistence in) a CD4+ T cell, e.g., an ICOS domain. In some embodiments, a CD8+ T cell comprises a CAR described herein, which CAR comprises an intracellular signaling domain suitable for (e.g., optimized for, e.g., leading to enhanced persistence of) a CD8+ T cell, e.g., a 4-1BB domain, a CD28 domain, or another costimulatory domain other than an ICOS domain. In some embodiments, the CAR described herein comprises an antigen binding domain described herein, e.g., a CAR comprising an antigen binding domain.

In an aspect, described herein is a method of treating a subject, e.g., a subject having cancer. The method includes administering to said subject, an effective amount of:

1) a CD4+ T cell comprising a CAR (the CARCD4+) comprising:
   an antigen binding domain, e.g., an antigen binding domain described herein;
   a transmembrane domain; and
   an intracellular signaling domain, e.g., a first costimulatory domain, e.g., an ICOS domain; and 2) a CD8+ T cell comprising a CAR (the CARCD8+) comprising:
an antigen binding domain, e.g., an antigen binding domain described herein;
a transmembrane domain; and an intracellular signaling domain, e.g., a second costimulatory domain, e.g., a 4-1BB domain, a CD28 domain, or another costimulatory domain other than an ICOS domain;
wherein the CARCD4+ and the CARCD8+ differ from one another.
Optionally, the method further includes administering:
3) a second CD8+ T cell comprising a CAR (the second CARCD8+) comprising:
an antigen binding domain, e.g., an antigen binding domain described herein;
a transmembrane domain; and
an intracellular signaling domain, wherein the second CARCD8+ comprises an intracellular signaling domain, e.g., a costimulatory signaling domain, not present on the CARCD8+, and, optionally, does not comprise an ICOS signaling domain.

Methods of Manufacture/Production

In some embodiments, the methods disclosed herein further include administering a T cell depleting agent after treatment with the cell (e.g., an immune effector cell as described herein, e.g., an immune effector cell expressing CAR driven by a truncated PGK1 promoter), thereby reducing (e.g., depleting) the CAR-expressing cells (e.g., the CD19CAR-expressing cells). Such T cell depleting agents can be used to effectively deplete CAR-expressing cells (e.g., CD19CAR-expressing cells) to mitigate toxicity. In some embodiments, the CAR-expressing cells were manufactured according to a method herein, e.g., assayed (e.g., before or after transfection or transduction) according to a method herein.

In some embodiments, the T cell depleting agent is administered one, two, three, four, or five weeks after administration of the cell, e.g., the population of immune effector cells, described herein.

In one embodiment, the T cell depleting agent is an agent that depletes CAR-expressing cells, e.g., by inducing antibody dependent cell-mediated cytotoxicity (ADCC) and/or complement-induced cell death. For example, CAR-expressing cells described herein may also express an antigen (e.g., a target antigen) that is recognized by molecules capable of inducing cell death, e.g., ADCC or complement-induced cell death. For example, CAR expressing cells described herein may also express a target protein (e.g., a receptor) capable of being targeted by an antibody or antibody fragment. Examples of such target proteins include, but are not limited to, EpCAM, VEGFR, integrins (e.g., integrins αvβ3, α4, αI3/4β3, α4β7, α5β1, αvβ3, αv), members of the TNF receptor superfamily (e.g., TRAIL-R1, TRAIL-R2), PDGF Receptor, interferon receptor, folate receptor, GPNMB, ICAM-1, HLA-DR, CEA, CA-125, MUC1, TAG-72, IL-6 receptor, 5T4, GD2, GD3, CD2, CD3, CD4, CD5, CD11, CD11a/LFA-1, CD15, CD18/ITGB2, CD19, CD20, CD22, CD23/lgE Receptor, CD25, CD28, CD30, CD33, CD38, CD40, CD41, CD44, CD51, CD52, CD62L, CD74, CD80, CD125, CD147/basigin, CD152/ CTLA-4, CD154/CD40L, CD195/CCR5, CD319/SLAMF7, and EGFR, and truncated versions thereof (e.g., versions preserving one or more extracellular epitopes but lacking one or more regions within the cytoplasmic domain).

In some embodiments, the CAR expressing cell co-expresses the CAR and the target protein, e.g., naturally expresses the target protein or is engineered to express the target protein. For example, the cell, e.g., the population of immune effector cells, can include a nucleic acid (e.g., vector) comprising the CAR nucleic acid (e.g., a CAR nucleic acid as described herein) and a nucleic acid encoding the target protein.

In one embodiment, the T cell depleting agent is a CD52 inhibitor, e.g., an anti-CD52 antibody molecule, e.g., alemtuzumab.

In other embodiments, the cell, e.g., the population of immune effector cells, expresses a CAR molecule as described herein (e.g., CD19CAR) and the target protein recognized by the T cell depleting agent. In one embodiment, the target protein is CD20. In embodiments where the target protein is CD20, the T cell depleting agent is an anti-CD20 antibody, e.g., rituximab.

In further embodiments of any of the aforesaid methods, the methods further include transplanting a cell, e.g., a hematopoietic stem cell, or a bone marrow, into the mammal.

In another aspect, the invention features a method of conditioning a mammal prior to cell transplantation. The method includes administering to the mammal an effective amount of the cell comprising a CAR nucleic acid or polypeptide, e.g., a CD19 CAR nucleic acid or polypeptide. In some embodiments, the cell transplantation is a stem cell transplantation, e.g., a hematopoietic stem cell transplantation, or a bone marrow transplantation. In other embodiments, conditioning a subject prior to cell transplantation includes reducing the number of target-expressing cells in a subject, e.g., CD19-expressing normal cells or CD19-expressing cancer cells.

Biopolymer Delivery Methods

In some embodiments, one or more CAR-expressing cells as disclosed herein can be administered or delivered to the subject via a biopolymer scaffold, e.g., a biopolymer implant. Biopolymer scaffolds can support or enhance the delivery, expansion, and/or dispersion of the CAR-expressing cells described herein. A biopolymer scaffold comprises a biocompatible (e.g., does not substantially induce an inflammatory or immune response) and/or a biodegradable polymer that can be naturally occurring or synthetic. Exemplary biopolymers are described, e.g., in paragraphs 1004-1006 of International Application WO2015/142675, filed Mar. 13, 2015, which is herein incorporated by reference in its entirety.

Therapeutic Applications

CD19 Associated Diseases and/or Disorders

In one aspect, the invention provides methods for treating a disease associated with CD19 expression. In one aspect, the invention provides methods for treating a disease wherein part of the cancer is negative for CD19 and part of the cancer is positive for CD19. For example, the methods and compositions of the invention are useful for treating subjects that have undergone treatment for a disease associated with expression of CD19, wherein the subject that has undergone treatment related to CD19 expression, e.g., treatment with a CD19 CAR, exhibits a disease associated with expression of CD19.

In another aspect, the invention provides methods for treating a disease associated with expression of a B-cell antigen, e.g., one or more of CD10, CD20, CD22, CD34, CD123, FLT-3, or ROR1. In one aspect, the invention provides methods for treating a disease wherein part of the tumor is negative for the B-cell antigen and part of the tumor is positive for B-cell antigen. For example, the compositions and methods of the invention are useful for treating subjects that have undergone treatment for a disease associated with expression of the B-cell antigen, wherein the subject that has undergone treatment related to expression of a B-cell antigen, e.g., treatment with a CAR targeting a B-cell antigen, exhibits a disease associated with expression of the B-cell antigen. In a third aspect, the invention provides methods for treating a disease associated with expression of the B-cell antigen, e.g., associated with the expression of CD19 and one or more other B-cell antigens.

In one aspect, the invention pertains to a vector comprising CD19 CAR operably linked to promoter for expression in mammalian cells, e.g., T cells or NK cells. In one aspect, the invention provides a recombinant cell, e.g., a T cell or NK cell, expressing the CD19 CAR for use in treating CD19-expressing cancers, wherein the recombinant T cell expressing the CD19 CAR is termed a CD19 CART. In one aspect, the CD19 CART described herein, is capable of contacting a cancer cell with at least one CD19 CAR expressed on its surface such that the CART targets the cancer cell and growth of the cancer is inhibited.

In one aspect the invention pertains to a CD22 inhibitor which is a CD22 CART, e.g., a T cell, expressing the CD22 CAR for use in treating CD22-expressing tumors in combination with CD19 CARTS, wherein the recombinant T cell expressing the CD22 CAR is termed a CD22 CART. In one aspect, the CD22 CART described herein, is capable of contacting a tumor cell with at least one CD22 CAR expressed on its surface such that the CD22 CART targets the tumor cell and growth of the tumor is inhibited.

In one aspect, the invention pertains to a method of inhibiting growth of a CD19-expressing cancer cell, comprising contacting the cancer cell with a CD19 CAR expressing cell, e.g., a CD19 CART cell, described, and one or more other CAR expressing cells, e.g., as described herein, such that the CART is activated in response to the antigen and targets the cancer cell, wherein the growth of the cancer is inhibited. The CD19 CAR-expressing cell, e.g., T cell, is administered in combination with a B-cell inhibitor, e.g., a B-cell inhibitor described herein.

In some embodiments, the CD19 inhibitor (e.g., one or more cells that express a CAR molecule that binds CD19, e.g., a CAR molecule that binds CD19 described herein) and the B cell inhibitor (e.g., one or more inhibitors of CD10, CD19, CD20, CD22, CD34, CD123, FLT-3, or ROR1, e.g., as described herein) are administered simultaneously. In some embodiments, the CD19 inhibitor and the B cell inhibitor are infused into a subject simultaneously, e.g., are admixed in the same infusion volume. In other embodiments, the simultaneous administration comprises separate administration of the CD19 inhibitor and the B cell inhibitor, e.g., administration of each is initiated within a predetermined time interval (e.g., within 15, 30, or 45 minutes of each other).

In some embodiments, the start of CD19 inhibitor delivery and the start of B cell inhibitor delivery are within 1, 2, 3, 4, 6, 12, 18, or 24 hours of each other, or within 1, 2, 3, 4, 5, 10, 15, 20, 25, 30, 35, 40, 60, 80, or 100 days of each other. In some embodiments, the end of CD19 inhibitor delivery and the end of B cell inhibitor delivery are within 1, 2, 3, 4, 6, 12, 18, or 24 hours of each other, or within 1, 2, 3, 4, 5, 10, 15, 20, 25, 30, 35, 40, 60, 80, or 100 days of each other. In some embodiments, the overlap in terms of administration between the CD19 inhibitor delivery (e.g., infusion) and the end of B cell inhibitor delivery (e.g., infusion) is at least 1, 2, 3, 4, 5, 10, 15, 20, 25, 30, or 45 minutes.

In some embodiments, the B cell inhibitor is administered while the one or more cells that express a CAR molecule that binds CD19 are present (e.g., undergoing expansion) in the subject. In some embodiments, the CD19 inhibitor is administered while the one or more cells that express a CAR molecule that binds one or more of CD10, CD20, CD22, CD34, CD123, FLT-3, ROR1, CD79b, CD179b, or CD79a are present (e.g., undergoing expansion) in the subject.

The invention includes (among other things) a type of cellular therapy where T cells are genetically modified to express a chimeric antigen receptor (CAR) and the CAR T cell is infused to a recipient in need thereof. The infused cell is able to kill tumor cells in the recipient. Unlike antibody therapies, CAR-modified T cells are able to replicate in vivo resulting in long-term persistence that can lead to sustained tumor control. In various aspects, the T cells administered to the patient, or their progeny, persist in the patient for at least four months, five months, six months, seven months, eight months, nine months, ten months, eleven months, twelve months, thirteen months, fourteen month, fifteen months, sixteen months, seventeen months, eighteen months, nineteen months, twenty months, twenty-one months, twenty-two months, twenty-three months, two years, three years, four years, or five years after administration of the T cell to the patient.

The invention also includes a type of cellular therapy where immune effector cells, e.g., NK cells or T cells are modified, e.g., by in vitro transcribed RNA, to transiently express a chimeric antigen receptor (CAR) and the CAR-expressing (e.g., CAR T) cell is infused to a recipient in need thereof. The infused cell is able to kill cancer cells in the recipient. Thus, in various aspects, the CAR-expressing cells, e.g., T cells, administered to the patient, is present for less than one month, e.g., three weeks, two weeks, one week, after administration of the CAR-expressing cell, e.g., T cell, to the patient.

Without wishing to be bound by any particular theory, the anti-cancer immunity response elicited by the CAR-modified T cells may be an active or a passive immune response, or alternatively may be due to a direct vs indirect immune response. In one aspect, the CAR (e.g., CD19-CAR) transduced T cells exhibit specific proinflammatory cytokine secretion and potent cytolytic activity in response to human cancer cells expressing the target antigen (e.g., CD19), resist soluble target antigen inhibition, mediate bystander killing and mediate regression of an established human cancer. For example, antigen-less cancer cells within a heterogeneous field of target antigen-expressing cancer may be susceptible to indirect destruction by target antigen-redirected T cells that has previously reacted against adjacent antigen-positive cancer cells.

In one aspect, the CAR-modified cells of the invention, e.g., fully human CAR T cells, may be a type of vaccine for ex vivo immunization and/or in vivo therapy in a mammal. In one aspect, the mammal is a human.

With respect to ex vivo immunization, at least one of the following occurs in vitro prior to administering the cell into a mammal: i) expansion of the cells, ii) introducing a nucleic acid encoding a CAR to the cells or iii) cryopreservation of the cells.

Ex vivo procedures are well known in the art and are discussed more fully below. Briefly, cells are isolated from a mammal (e.g., a human) and genetically modified (i.e., transduced or transfected in vitro) with a vector expressing a CAR disclosed herein. The CAR-modified cell can be administered to a mammalian recipient to provide a therapeutic benefit. The mammalian recipient may be a human and the CAR-modified cell can be autologous with respect to the recipient. Alternatively, the cells can be allogeneic, syngeneic or xenogeneic with respect to the recipient.

The procedure for ex vivo expansion of hematopoietic stem and progenitor cells is described in U.S. Pat. No. 5,199,942, incorporated herein by reference, can be applied to the cells of the present invention. Other suitable methods are known in the art, therefore the present invention is not limited to any particular method of ex vivo expansion of the cells. Briefly, ex vivo culture and expansion of T cells can comprise: (1) collecting CD34+ hematopoietic stem and progenitor cells from a mammal from peripheral blood harvest or bone marrow explants; and (2) expanding such cells ex vivo. In addition to the cellular growth factors described in U.S. Pat. No. 5,199,942, other factors such as flt3-L, IL-1, IL-3 and c-kit ligand, can be used for culturing and expansion of the cells.

In addition to using a cell-based vaccine in terms of ex vivo immunization, also included in the methods described herein are compositions and methods for in vivo immunization to elicit an immune response directed against an antigen in a patient.

Generally, the cells activated and expanded as described herein may be utilized in the treatment and prevention of diseases that arise in individuals who are immunocompromised. In particular, the CAR-expressing cells described herein are used in the treatment of diseases, disorders and conditions associated with expression of one or more B-cell antigen. In certain aspects, the cells are used in the treatment of patients at risk for developing diseases, disorders and conditions associated with expression of one or more B-cell antigen. Thus, the present invention provides (among other things) methods for the treatment or prevention of diseases, disorders and conditions associated with expression of a B-cell antigen comprising administering to a subject in need thereof, a therapeutically effective amount of the CD19 CAR-expressing cells described herein, in combination with one or more of B-cell inhibitor described herein.

The present invention also provides methods for inhibiting the proliferation or reducing a CD19-expressing cell population, the methods comprising contacting a population of cells comprising a CD19-expressing cell with an anti-CD19 CAR-expressing cell described herein that binds to the CD19-expressing cell, and contacting the population of CD19-expressing cells with one or more of a B-cell inhibitor described herein. In a specific aspect, the present invention provides methods for inhibiting the proliferation or reducing the population of cancer cells expressing CD19, the methods comprising contacting the CD19-expressing cancer cell population with an anti-CD19 CAR-expressing cell described herein that binds to the CD19-expressing cell, and contacting the CD19-expressing cell with one or more B-cell described herein. In one aspect, the present invention provides methods for inhibiting the proliferation or reducing the population of cancer cells expressing CD19, the methods comprising contacting the CD19-expressing cancer cell population with an anti-CD19 CAR-expressing cell described herein that binds to the CD19-expressing cell and contacting the CD19-expressing cell with one or more B-cell described herein. In certain aspects, the combination of the anti-CD19 CAR-expressing cell described herein and one or more B-cell described herein reduces the quantity, number, amount or percentage of cells and/or cancer cells by at least 25%, at least 30%, at least 40%, at least 50%, at least 65%, at least 75%, at least 85%, at least 95%, or at least 99% in a subject with or animal model for a hematological cancer or another cancer associated with CD19-expressing cells relative to a negative control. In one aspect, the subject is a human.

The present invention also provides methods for inhibiting the proliferation or reducing a cell population comprising CD19-expressing cells and cells expressing a second B-cell antigen. In one aspect, CD19 and second B-cell antigen are expressed by the same cells within the population. In another aspect, CD19 and second B-cell antigen are expressed by distinct subsets of cells within the population. In another aspect, CD19 and second B-cell antigen are expressed by overlapping subsets of cells within the population, such that some cells express CD19 and second B-cell antigen, some cells express CD19, and some cells express the second B-cell antigen.

The present invention also provides methods for inhibiting the proliferation or reducing a cell population expressing CD19 and a second B-cell antigen, the methods comprising (i) contacting a population of cells comprising a CD19-expressing cell with an anti-CD19 CAR-expressing cell described herein that binds to the CD19-expressing cell, and (ii) contacting the second B-cell antigen-expressing cell with a second CAR-expressing cell described herein that binds to the second B-cell antigen-expressing cell. In a specific aspect, the present invention provides methods for inhibiting the proliferation or reducing the population of cancer cells expressing CD19 and a second B-cell antigen, the methods comprising (i) contacting the CD19-expressing cancer cell population with an anti-CD19 CAR-expressing cell described herein that binds to the CD19-expressing cell, and (ii) contacting the second B-cell antigen-expressing cell population with a second CAR-expressing cell described herein that binds to the cell expressing the second B-cell antigen. In one aspect, the present invention provides methods for inhibiting the proliferation or reducing the population of cancer cells expressing CD19 and/or a second B-cell antigen, the methods comprising (i) contacting the CD19-expressing cancer cell population with an anti-CD19 CAR-expressing cell described herein that binds to the CD19-expressing cell and (ii) contacting the second B-cell antigen-expressing cell population with a second CAR-expressing cell described herein that binds to the cell expressing the second B-cell antigen. In certain aspects, the combination of the anti-CD19 CAR-expressing cell described herein and the second CAR-expressing cell described herein, reduces the quantity, number, amount or percentage of cells and/or cancer cells by at least 25%, at least 30%, at least 40%, at least 50%, at least 65%, at least 75%, at least 85%, at least 95%, or at least 99% in a subject with or animal model for a hematological cancer or another cancer associated with CD19 and/or second B-cell antigen-expressing cells relative to a negative control. In one aspect, the subject is a human.

The present invention also provides methods for preventing, treating and/or managing a disease associated with CD19-expressing cells (e.g., a hematologic cancer or atypical cancer expressing CD19), the methods comprising administering to a subject in need an anti-CD19 CAR-expressing cell that binds to the CD19-expressing cell and administering one or B-cell inhibitor described herein. In one aspect, the subject is a human. Non-limiting examples of disorders associated with CD19-expressing cells include autoimmune disorders (such as lupus), inflammatory disorders (such as allergies and asthma) and cancers (such as hematological cancers or atypical cancers expressing CD19).

The present invention also provides methods for preventing, treating and/or managing a disease associated with CD19 and/or a second B-cell antigen-expressing cells (e.g., a hematologic cancer or atypical cancer expressing CD19 and/or second B-cell antigen), the methods comprising administering to a subject in need an anti-CD19 CAR-expressing cell that binds to the CD19-expressing cell and a B-cell inhibitor.

The present invention also provides methods for preventing, treating and/or managing a disease associated with CD19-expressing cells, the methods comprising administering to a subject in need an anti-CD19 CART cell of the invention that binds to the CD19-expressing cell. In one aspect, the subject is a human.

The present invention also provides methods for preventing relapse of cancer associated with CD19-expressing cells, the methods comprising administering to a subject in need thereof an anti-CD19 CART cell of the invention that binds to the CD19-expressing cell. In one aspect, the methods comprise administering to the subject in need thereof an effective amount of an anti-CD19 CART cell described herein that binds to the CD19-expressing cell in combination with an effective amount of another therapy.

In one aspect, the invention pertains to a method of treating cancer in a subject. The method comprises administering to the subject a CD19 CAR-expressing cell, e.g., T cell, described herein, in combination with a B-cell inhibitor, such that the cancer is treated in the subject. An example of a cancer that is treatable by the methods described herein is a cancer associated with expression of CD19. In one embodiment, the disease is a solid or liquid tumor. In one embodiment, the disease is a hematologic cancer, e.g., as described herein.

Non-cancer related indications associated with expression of CD19 include, but are not limited to, e.g., autoimmune disease, (e.g., lupus), inflammatory disorders (allergy and asthma) and transplantation.

In some embodiments, a cancer that can be treated with the combination described herein is multiple myeloma. Multiple myeloma is a cancer of the blood, characterized by accumulation of a plasma cell clone in the bone marrow. Current therapies for multiple myeloma include, but are not limited to, treatment with lenalidomide, which is an analog of thalidomide. Lenalidomide has activities which include anti-tumor activity, angiogenesis inhibition, and immunomodulation. In some embodiments, a CD19 CAR, e.g., as described herein, may be used to target myeloma cells. In some embodiments, the combination described herein can be used with one or more additional therapies, e.g., lenalidomide treatment.

The CAR-expressing cells described herein may be administered either alone, or as a pharmaceutical composition in combination with diluents and/or with other components such as IL-2 or other cytokines or cell populations.

Hematologic Cancers

Hematological cancer conditions are the types of cancer such as leukemia, lymphoma and malignant lymphoproliferative conditions that affect blood, bone marrow and the lymphatic system.

In one embodiment, the hematologic cancer is leukemia. In one embodiment, the cancer is selected from the group consisting of one or more acute leukemias including but not limited to B-cell acute lymphoid leukemia (BALL), T-cell acute lymphoid leukemia (TALL), small lymphocytic leukemia (SLL), acute lymphoid leukemia (ALL); one or more chronic leukemias including but not limited to chronic myelogenous leukemia (CML), chronic lymphocytic leukemia (CLL); additional hematologic cancers or hematologic conditions including, but not limited to mantle cell lymphoma (MCL), B cell prolymphocytic leukemia, blastic plasmacytoid dendritic cell neoplasm, Burkitt's lymphoma, diffuse large B cell lymphoma, follicular lymphoma, hairy cell leukemia, small cell- or a large cell-follicular lymphoma, malignant lymphoproliferative conditions, MALT lymphoma, Marginal zone lymphoma, multiple myeloma, myelodysplasia and myelodysplastic syndrome, non-Hodgkin lymphoma, Hodgkin lymphoma, plasmablastic lymphoma, plasmacytoid dendritic cell neoplasm, Waldenstrom macroglobulinemia, and "preleukemia" which are a diverse collection of hematological conditions united by ineffective production (or dysplasia) of myeloid blood cells. Diseases associated with CD19, CD20, or CD22 expression include, but not limited to atypical and/or non-classical cancers, malignancies, precancerous conditions or proliferative diseases expressing CD19, CD20, or CD22; and any combination thereof.

Leukemia can be classified as acute leukemia and chronic leukemia. Acute leukemia can be further classified as acute myelogenous leukemia (AML) and acute lymphoid leukemia (ALL). Chronic leukemia includes chronic myelogenous leukemia (CML) and chronic lymphoid leukemia (CLL). Other related conditions include myelodysplastic syndromes (MDS, formerly known as "preleukemia") which are a diverse collection of hematological conditions united by ineffective production (or dysplasia) of myeloid blood cells and risk of transformation to AML.

Lymphoma is a group of blood cell tumors that develop from lymphocytes. Exemplary lymphomas include non-Hodgkin lymphoma and Hodgkin lymphoma.

In an aspect, the invention pertains to a method of treating a mammal having Hodgkin lymphoma, comprising administering to the mammal an effective amount of the cells expressing a CD19 CAR molecule, e.g., a CD19 CAR molecule described herein and a B-cell inhibitor.

In one aspect, the compositions and CART cells or CAR expressing NK cells of the present invention are particularly useful for treating B cell malignancies, such as non-Hodgkin lymphomas, e.g., DLBCL, Follicular lymphoma, or CLL.

Non-Hodgkin lymphoma (NHL) is a group of cancers of lymphocytes, formed from either B or T cells. NHLs occur at any age and are often characterized by lymph nodes that are larger than normal, weight loss, and fever. Different types of NHLs are categorized as aggressive (fast-growing) and indolent (slow-growing) types. B-cell non-Hodgkin lymphomas include Burkitt lymphoma, chronic lymphocytic leukemia/small lymphocytic lymphoma (CLL/SLL), diffuse large B-cell lymphoma (DLBCL), follicular lymphoma, immunoblastic large cell lymphoma, precursor B-lymphoblastic lymphoma, and mantle cell lymphoma. Examples of T-cell non-Hodgkin lymphomas include mycosis fungoides, anaplastic large cell lymphoma, and precursor T-lymphoblastic lymphoma. Lymphomas that occur after bone marrow or stem cell transplantation are typically B-cell non-Hodgkin lymphomas. See, e.g., Maloney. NEJM. 366.21 (2012):2008-16.

Diffuse large B-cell lymphoma (DLBCL) is a form of NHL that develops from B cells. DLBCL is an aggressive lymphoma that can arise in lymph nodes or outside of the lymphatic system, e.g., in the gastrointestinal tract, testes, thyroid, skin, breast, bone, or brain. Three variants of cellular morphology are commonly observed in DLBCL: centroblastic, immunoblastic, and anaplastic. Centroblastic morphology is most common and has the appearance of medium-to-large-sized lymphocytes with minimal cytoplasm. There are several subtypes of DLBCL. For example, primary central nervous system lymphoma is a type of DLBCL that only affects the brain is called and is treated differently than DLBCL that affects areas outside of the brain. Another type of DLBCL is primary mediastinal B-cell lymphoma, which often occurs in younger patients and grows rapidly in the chest. Symptoms of DLBCL include a painless rapid swelling in the neck, armpit, or groin, which is caused by enlarged lymph nodes. For some subjects, the swelling may be painful. Other symptoms of DLBCL include night sweats, unexplained fevers, and weight loss. Although most patients with DLBCL are adults, this disease sometimes occurs in children. Treatment for DLBCL includes chemotherapy (e.g., cyclophosphamide, doxorubicin, vincristine, prednisone, etoposide), antibodies (e.g., Rituxan), radiation, or stem cell transplants.

Follicular lymphoma a type of non-Hodgkin lymphoma and is a lymphoma of follicle center B-cells (centrocytes and centroblasts), which has at least a partially follicular pattern. Follicular lymphoma cells express the B-cell markers CD10, CD19, CD20, and CD22. Follicular lymphoma cells are commonly negative for CD5. Morphologically, a follicular lymphoma tumor is made up of follicles containing a mixture of centrocytes (also called cleaved follicle center cells or small cells) and centroblasts (also called large noncleaved follicle center cells or large cells). The follicles are surrounded by non-malignant cells, mostly T-cells. The follicles contain predominantly centrocytes with a minority of centroblasts. The World Health Organization (WHO) morphologically grades the disease as follows: grade 1 (<5 centroblasts per high-power field (hpf); grade 2 (6-15 centroblasts/hpf); grade 3 (>15 centroblasts/hpf). Grade 3 is further subdivided into the following grades: grade 3A (centrocytes still present); grade 3B (the follicles consist almost entirely of centroblasts). Treatment of follicular lymphoma includes chemotherapy, e.g., alkyating agents, nucleoside analogs, anthracycline-containing regimens, e.g., a combination therapy called CHOP—cyclophosphamide, doxorubicin, vincristine, prednisone/prednisolone, antibodies (e.g., rituximab), radioimmunotherapy, and hematopoietic stem cell transplantation.

CLL is a B-cell malignancy characterized by neoplastic cell proliferation and accumulation in bone morrow, blood, lymph nodes, and the spleen. The median age at time of diagnosis of CLL is about 65 years. Current treatments include chemotherapy, radiation therapy, biological therapy, or bone marrow transplantation. Sometimes symptoms are treated surgically (e.g., splenectomy removal of enlarged spleen) or by radiation therapy (e.g., de-bulking swollen lymph nodes). Chemotherapeutic agents to treat CLL include, e.g., fludarabine, 2-chlorodeoxyadenosine (cladribine), chlorambucil, vincristine, pentostatin, cyclophosphamide, alemtuzumab (Campath-1H), doxorubicin, and prednisone. Biological therapy for CLL includes antibodies, e.g., alemtuzumab, rituximab, and ofatumumab; as well as tyrosine kinase inhibitor therapies. A number of criteria can be used to classify stage of CLL, e.g., the Rai or Binet system. The Rai system describes CLL has having five stages: stage 0 where only lymphocytosis is present; stage I where lymphadenopathy is present; stage II where splenomegaly, lymphadenopathy, or both are present; stage III where anemia, organomegaly, or both are present (progression is defined by weight loss, fatigue, fever, massive organomegaly, and a rapidly increasing lymphocyte count); and stage IV where anemia, thrombocytopenia, organomegaly, or a combination thereof are present. Under the Binet staging system, there are three categories: stage A where lymphocytosis is present and less than three lymph nodes are enlarged (this stage is inclusive of all Rai stage 0 patients, one-half of Rai stage I patients, and one-third of Rai stage II patients); stage B where three or more lymph nodes are involved; and stage C wherein anemia or thrombocytopenia, or both are present. These classification systems can be combined with measurements of mutation of the immunoglobulin genes to provide a more accurate characterization of the state of the disease. The presence of mutated immunoglobulin genes correlates to improved prognosis.

In another embodiment, the CAR expressing cells of the present invention are used to treat cancers or leukemias, e.g., with leukemia stem cells. For example, the leukemia stem cells are $CD34^+/CD38^-$ leukemia cells.

CD20 and CD22 Associated Diseases and/or Disorders

The present invention provides, among other things, compositions and methods for treating a disease associated with expression of CD20 or CD22 or condition associated with cells which express CD20 or CD22 including, e.g., a proliferative disease such as a cancer or malignancy or a precancerous condition; or a noncancer related indication associated with cells which express CD20 or CD22. In one aspect, a cancer associated with expression of CD22 is a hematological cancer, e.g., a hematological cancer described herein.

Non-cancer related indications associated with expression of CD20 or CD22 may also be included. Non-cancer related indications associated with expression of CD20 or CD22 include, but are not limited to, e.g., autoimmune disease, (e.g., lupus, rheumatoid arthritis, multiple sclerosis autoimmune hemolytic anemia, pure red cell aplasia, idiopathic thrombocytopenic purpura, Evans syndrome, vasculitis, bullous skin disorders, type 1 diabetes mellitus, Sjogren's syndrome, anti-NMDA receptor encephalitis and Devic's disease, Graves' ophthalmopathy, and autoimmune pancreatitis), inflammatory disorders (allergy and asthma) and solid-organ or hematopoietic cell transplantation.

Compositions and methods disclosed herein may be used to treat hematologic diseases including, but not limited to myelodysplasia, anemia, paroxysmal nocturnal hemoglobinuria, aplastic anemia, acquired pure red cell anemia, Diamon-Blackfan anemia, Fanconi anemia, cytopenia, amegakaryotic thrombocytopenia, myeloproliferative disorders, polycythemia vera, essential thrombocytosis, myelofibrosis, hemoglobinopathies, sickle cell disease, β thalassemia major, among others.

In one aspect, the invention provides methods for treating a disease associated with CD22 expression. In one aspect, the invention provides methods for treating a disease wherein part of the tumor is negative for CD20 or CD22 and part of the tumor is positive for CD20 or CD22. For example, the CAR of the invention is useful for treating subjects that have undergone treatment for a disease associated with expression of CD20 or CD22, wherein the subject that has undergone treatment related to expression of CD20 or CD22 exhibits a disease associated with expression of CD20 or CD22.

In one aspect, the invention pertains to a method of inhibiting growth of a CD20 or CD22-expressing tumor cell, comprising contacting the tumor cell with a CD20 or CD22 CAR cell (e.g., T cell or NK cell) of the present invention such that the CART is activated in response to the antigen and targets the cancer cell, wherein the growth of the tumor is inhibited.

In one aspect, the invention pertains to a method of treating cancer in a subject. The method comprises administering to the subject a CD20 or CD22 CAR expressing cell (e.g., T cell or NK cell) of the present invention such that the cancer is treated in the subject. An example of a cancer that is treatable by the CD20 or CD22 CAR expressing cell (e.g., T cell or NK cell) of the invention is a cancer associated with expression of CD20 or CD22. An example of a cancer that is treatable by the CD20 or CD22 CAR expressing cell (e.g., T cell or NK cell) of the invention includes but is not limited to a hematological cancer described herein.

The invention includes a type of cellular therapy where cells (e.g., T cells or NK cells) are genetically modified to express a chimeric antigen receptor (CAR) and the CAR expressing cell (e.g., T cell or NK cells) is infused to a recipient in need thereof. The infused cell is able to kill tumor cells in the recipient. Unlike antibody therapies, CAR-modified cells (e.g., T cells or NK cells) are able to replicate in vivo resulting in long-term persistence that can lead to sustained tumor control. In various aspects, the cells (e.g., T cells or NK cells) administered to the patient, or their progeny, persist in the patient for at least four months, five months, six months, seven months, eight months, nine months, ten months, eleven months, twelve months, thirteen months, fourteen month, fifteen months, sixteen months, seventeen months, eighteen months, nineteen months, twenty months, twenty-one months, twenty-two months, twenty-three months, two years, three years, four years, or five years after administration of the T cell to the patient.

The invention also includes a type of cellular therapy where immune effector cells, e.g., NK cells or T cells are modified, e.g., by in vitro transcribed RNA, to transiently express a chimeric antigen receptor (CAR) and the CAR-expressing (e.g., CART or CAR expressing NK cell) cell is infused to a recipient in need thereof. The infused cell is able to kill cancer cells in the recipient. Thus, in various aspects, the CAR-expressing cells, e.g., T cells or NK cells, are administered to the patient, is present for less than one month, e.g., three weeks, two weeks, one week, after administration of the CAR-expressing cell, e.g., T cells or NK cell, to the patient.

Without wishing to be bound by any particular theory, the anti-tumor immunity response elicited by the CAR-modified cells (e.g., T cells or NK cells) may be an active or a passive immune response, or alternatively may be due to a direct vs indirect immune response. In one aspect, the CAR transduced cells (e.g., T cells or NK cells) exhibit specific proinflammatory cytokine secretion and potent cytolytic activity in response to human cancer cells expressing CD20 or CD22, resist soluble CD20 or CD22 inhibition, mediate bystander killing and mediate regression of an established human tumor. For example, antigen-less tumor cells within a heterogeneous field of CD20 or CD22-expressing tumor may be susceptible to indirect destruction by CD20 or CD22-redirected T cells that has previously reacted against adjacent antigen-positive cancer cells.

In one aspect, the CAR-modified cells (e.g., T cells or NK cells) of the invention, e.g., fully human CAR-expressing cells, may be a type of vaccine for ex vivo immunization and/or in vivo therapy in a mammal. In one aspect, the mammal is a human.

With respect to ex vivo immunization, at least one of the following occurs in vitro prior to administering the cell into a mammal: i) expansion of the cells, ii) introducing a nucleic acid encoding a CAR to the cells or iii) cryopreservation of the cells.

Ex vivo procedures are well known in the art and are discussed more fully below. Briefly, cells are isolated from a mammal (e.g., a human) and genetically modified (i.e., transduced or transfected in vitro) with a vector expressing a CAR disclosed herein. The CAR-modified cell can be administered to a mammalian recipient to provide a therapeutic benefit. The mammalian recipient may be a human and the CAR-modified cell can be autologous with respect to the recipient. Alternatively, the cells can be allogeneic, syngeneic or xenogeneic with respect to the recipient.

The procedure for ex vivo expansion of hematopoietic stem and progenitor cells is described in U.S. Pat. No. 5,199,942, incorporated herein by reference, can be applied to the cells of the present invention. Other suitable methods are known in the art, therefore the present invention is not limited to any particular method of ex vivo expansion of the cells. Briefly, ex vivo culture and expansion of T cells comprises: (1) collecting CD34+ hematopoietic stem and progenitor cells from a mammal from peripheral blood harvest or bone marrow explants; and (2) expanding such cells ex vivo. In addition to the cellular growth factors described in U.S. Pat. No. 5,199,942, other factors such as flt3-L, IL-1, IL-3 and c-kit ligand, can be used for culturing and expansion of the cells.

In addition to using a cell-based vaccine in terms of ex vivo immunization, the present invention also provides compositions and methods for in vivo immunization to elicit an immune response directed against an antigen in a patient.

Generally, the cells activated and expanded as described herein may be utilized in the treatment and prevention of diseases that arise in individuals who are immunocompromised. In particular, the CAR-modified cells (e.g., T cells or NK cells) of the invention are used in the treatment of diseases, disorders and conditions associated with expression of CD20 or CD22. In certain aspects, the cells of the invention are used in the treatment of patients at risk for developing diseases, disorders and conditions associated with expression of CD20 or CD22. Thus, the present invention provides methods for the treatment or prevention of diseases, disorders and conditions associated with expression of CD20 or CD22 comprising administering to a subject in need thereof, a therapeutically effective amount of the CAR-modified cells (e.g., T cells or NK cells) of the invention.

In one aspect the CAR expressing cells of the inventions may be used to treat a proliferative disease such as a cancer or malignancy or is a precancerous condition. In one aspect, a cancer associated with expression of CD20 or CD22 is a hematological cancer preleukemia, hyperproliferative disorder, hyperplasia or a dysplasia, which is characterized by abnormal growth of cells.

The CAR-modified cells of the present invention may be administered either alone, or as a pharmaceutical composition in combination with diluents and/or with other components such as IL-2 or other cytokines or cell populations.

The present invention also methods for inhibiting the proliferation or reducing a CD20 or CD22-expressing cell population, the methods comprising contacting a population of cells comprising a CD20 or CD22-expressing cell with a CD20 or CD22 CAR expressing cell of the invention that binds to the CD20 or CD22-expressing cell. In a specific aspect, the present invention provides methods for inhibiting the proliferation or reducing the population of cancer cells expressing CD20 or CD22, the methods comprising contacting the CD20 or CD22-expressing cancer cell population with a CD20 or CD22 CAR expressing cell of the invention that binds to the CD20 or CD22-expressing cell. In one aspect, the present invention provides methods for inhibiting the proliferation or reducing the population of cancer cells expressing CD20 or CD22, the methods comprising contacting the CD20 or CD22-expressing cancer cell population with a CD20 or CD22 CART of the invention that binds to the CD20 or CD22-expressing cell. In certain aspects, the CD20 or CD22 CAR expressing cell of the invention reduces the quantity, number, amount or percentage of cells and/or cancer cells by at least 25%, at least 30%, at least 40%, at least 50%, at least 65%, at least 75%, at least 85%, at least 95%, or at least 99% in a subject with or animal model for B-cell malignancy or another cancer associated with CD20 or CD22-expressing cells relative to a negative control. In one aspect, the subject is a human.

The present invention provides methods for preventing relapse of cancer associated with CD20 or CD22-expressing cells, the methods comprising administering to a subject in need thereof a CD20 or CD22 CAR expressing cell of the invention that binds to the CD20 or CD22-expressing cell. In one aspect, the methods comprise administering to the subject in need thereof an effective amount of a CD20 or CD22 CAR expressing cell described herein that binds to the CD20 or CD22-expressing cell in combination with an effective amount of another therapy.

In some embodiments, the CD22 expressing cell expresses CD19, CD123, FLT-3, ROR-1, CD79b, CD179b, CD79a, CD10, CD34, and/or CD20. In certain embodiments, the CD22 expressing cell expresses CD19. In some embodiments, the CD22-expressing cell does not express CD19. In some embodiments, the CD20 expressing cell expresses CD19, CD123, FLT-3, ROR-1, CD79b, CD179b, CD79a, CD10, CD34, and/or CD22. In certain embodiments, the CD20 expressing cell expresses CD19. In some embodiments, the CD20-expressing cell does not express CD19.

In some embodiments, the subject is a non-responder to CD19 CAR therapy. In some embodiments, the subject is a partial responder to CD19 CAR therapy. In some embodiments, the subject is a complete responder to CD19 CAR therapy. In some embodiments, the subject is a non-relapser to CD19 CAR therapy. In some embodiments, the subject is a partial relapser to CD19 CAR therapy. In some embodiments, the subject is a complete relapser to CD19 CAR therapy.

In some embodiments, a cancer or other condition that was previously responsive to treatment with CD19 CAR-expressing cells does not express CD19. In some embodiments, a cancer or other condition that was previously responsive to treatment with CD19 CAR-expressing cells has a 10%, 20%, 30%, 40%, 50% or more reduction in CD19 expression levels relative to when the cancer or other condition was responsive to treatment with CD19 CAR-expressing cells. In some embodiments, a cancer or other condition that was previously responsive to treatment with CD19 CAR-expressing cells expresses CD20, CD22, CD123, or any combination thereof.

In some embodiments, the CD20 or CD22 CAR-expressing cell of the invention is administered post-relapse of a cancer or other condition previously treated with CD19 CAR-expressing cell. In some embodiments, a CD19 CAR-expressing cell and a CD20 or CD22 CAR-expressing cell are administered concurrently, as described herein.

Bone Marrow Ablation

In one aspect, the present invention provides compositions and methods for bone marrow ablation. For example, in one aspect, the invention provides compositions and methods for eradication of at least a portion of existing bone marrow in a subject. It is described herein that, in certain instances, the CD19, C20, or CD22 CAR expressing cell comprising a CAR of the present invention eradicates CD19, C20, or CD22 positive bone marrow myeloid progenitor cells.

In one aspect, the invention provides a method of bone marrow ablation comprising administering a CD19, C20, or CD22 expressing CAR cell (e.g., T cell or NK cell) of the invention to a subject in need of bone marrow ablation. For example, the present method may be used to eradicate some or all of the existing bone marrow of a subject having a disease or disorder in which bone marrow transplantation or bone marrow reconditioning is a beneficial treatment strategy. In one aspect, the bone marrow ablation method of the invention, comprising the administration of a CD19, C20, or CD22 expressing CAR cell (e.g., T cell or NK cell) described elsewhere herein, is performed in a subject prior to bone marrow transplantation. Thus, in one aspect, the method of the invention provides a cellular conditioning regimen prior to bone marrow or stem cell transplantation. In one aspect, bone marrow transplantation comprises transplantation of a stem cell. The bone marrow transplantation may comprise transplantation of autologous or allogeneic cells.

The present invention provides a method of treating a disease or disorder comprising administering a CD19, C20, or CD22 expressing CAR cell (e.g., T cell or NK cell) of the invention to eradicate at least a portion of existing bone marrow. The method may be used as at least a portion of a treatment regimen for treating any disease or disorder where bone marrow transplantation is beneficial. That is, the present method may be used in any subject in need of a bone marrow transplant. In one aspect, bone marrow ablation comprising administration of a CD19, C20, or CD22 expressing CAR cell (e.g., T cell or NK cell) is useful in the treatment of AML. In certain aspects, bone marrow ablation by way of the present method is useful in treating a hematological cancer, a solid tumor, a hematologic disease, a metabolic disorder, HIV, HTLV, a lysosomal storage disorder, and an immunodeficiency.

Compositions and methods disclosed herein may be used to eradicate at least a portion of existing bone marrow to treat hematological cancers including, but not limited to, cancers described herein, e.g., leukemia, lymphoma, myeloma, ALL, AML, CLL, CML, Hodgkin lymphoma, Non-Hodgkin lymphoma (e.g., DLBCL or follicular lymphoma), and multiple myeloma.

In one aspect, the present invention provides a method of treating cancer comprising bone marrow conditioning, where at least a portion of bone marrow of the subject is eradicated by the CD22 CAR cell (e.g., T cell or NK cell) of the invention. For example, in certain instances, the bone marrow of the subject comprises a malignant precursor cell that can be targeted and eliminated by the activity of the C20 or CD22 CAR cell (e.g., T cell or NK cell). In one aspect, a bone marrow conditioning therapy comprises administering a bone marrow or stem cell transplant to the subject following the eradication of native bone marrow. In one aspect, the bone marrow reconditioning therapy is combined with one or more other anti-cancer therapies, including, but not limited to anti-tumor CAR therapies, chemotherapy, radiation, and the like.

In one aspect, eradication of the administered CD19, CD20, or CD22 CAR expressing cells may be required prior to infusion of bone marrow or stem cell transplant. Eradication of the CD19, CD20, or CD22 expressing CAR cell (e.g., T cell or NK cell) may be accomplished using any suitable strategy or treatment, including, but not limited to, use of a suicide gene, limited CAR persistence using RNA encoded CARs, or anti-T cell modalities including antibodies or chemotherapy.

Combination Therapies

The combination of a CAR as described herein (e.g., a CD20 CAR, a CD22 CAR, or a CD19 CAR-expressing cell described herein e.g., and one or more B-cell inhibitors, e.g., as described herein) may be used in combination with other known agents and therapies.

A CAR-expressing cell described herein (e.g., a CD20 CAR, a CD22 CAR, or a CD19 CAR-expressing cell), optionally the one or more B-cell inhibitors, and/or the at least one additional therapeutic agent can be administered simultaneously, in the same or in separate compositions, or sequentially. For sequential administration, the CAR-expressing cell described herein (e.g., a CD20 CAR, a CD22 CAR, or a CD19 CAR-expressing cell) can be administered first, and the additional agent can be administered second, or the order of administration can be reversed.

The CAR therapy and/or other therapeutic agents (such as a second CAR therapy), procedures or modalities can be administered during periods of active disorder, or during a period of remission or less active disease. The CAR therapy can be administered before the other treatment, concurrently with the treatment, post-treatment, or during remission of the disorder.

For instance, in some embodiments, CAR therapy is administered to a subject having a disease associated with CD19, CD20, or CD22 expression, e.g., a cancer. The subject can be assayed for indicators of responsiveness or relapse. In some embodiments, when the subject shows one or more signs of relapse, e.g., a frameshift and/or premature stop codon in CD19, an additional therapy is administered. In embodiments, the additional therapy is a B-cell inhibitor. The CD19 therapy may be continued (for instance, when there are still some CD19-expressing cancer cells detectable in the subject) or may be discontinued (for instance, when a risk-benefit analysis favors discontinuing the therapy).

When administered in combination, the CAR therapy and the additional agent (e.g., second or third agent), or all, can be administered in an amount or dose that is higher, lower or the same than the amount or dosage of each agent used individually, e.g., as a monotherapy. In certain embodiments, the administered amount or dosage of the CAR therapy, the additional agent (e.g., second or third agent), or all, is lower (e.g., at least 20%, at least 30%, at least 40%, or at least 50%) than the amount or dosage of each agent used individually, e.g., as a monotherapy. In other embodiments, the amount or dosage of the CAR therapy, the additional agent (e.g., second or third agent), or all, that results in a desired effect (e.g., treatment of cancer) is lower (e.g., at least 20%, at least 30%, at least 40%, or at least 50% lower) than the amount or dosage of each agent used individually, e.g., as a monotherapy, required to achieve the same therapeutic effect.

In embodiments, one or more of the therapeutics in the combination therapy is an antibody molecule. Cancer antigens can be targeted with monoclonal antibody therapy. Monoclonal antibody (mAb) therapy has been shown to exert powerful antitumor effects by multiple mechanisms, including complement-dependent cytotoxicity (CDC), antibody-dependent cellular cytotoxicity (ADCC) and direct cell inhibition or apoptosis-inducing effects on tumor cells that over-express the target molecules.

In further aspects, the combination of the CAR-expressing cell described herein (e.g., a CD20 CAR, a CD22 CAR, or a CD19 CAR-expressing cell, optionally in combination with one or more B-cell inhibitor) may be used in a treatment regimen in combination with surgery, chemotherapy, radiation, an mTOR pathway inhibitor, immuno- suppressive agents, such as cyclosporin, azathioprine, methotrexate, mycophenolate, and FK506, antibodies, or other immunoablative agents such as CAMPATH, anti-CD3 antibodies or other antibody therapies, cytoxin, fludarabine, cyclosporin, FK506, rapamycin, mycophenolic acid, steroids, FR901228, cytokines, and irradiation. peptide vaccine, such as that described in Izumoto et al. 2008 J Neurosurg 108:963-971.

In one embodiment, the combination of a CD19, CD20, or CD22 CAR-expressing cell described herein (e.g., and one or more B-cell inhibitor) can be used in combination with a chemotherapeutic agent. Exemplary chemotherapeutic agents include an anthracycline (e.g., doxorubicin (e.g., liposomal doxorubicin)); a vinca alkaloid (e.g., vinblastine, vincristine, vindesine, vinorelbine); an alkylating agent (e.g., cyclophosphamide, decarbazine, melphalan, ifosfamide, temozolomide); an immune cell antibody (e.g., alemtuzamab, gemtuzumab, rituximab, tositumomab); an antimetabolite (including, e.g., folic acid antagonists, pyrimidine analogs, purine analogs and adenosine deaminase inhibitors (e.g., fludarabine)); a TNFR glucocorticoid induced TNFR related protein (GITR) agonist; a proteasome inhibitor (e.g., aclacinomycin A, gliotoxin or bortezomib); an immunomodulator such as thalidomide or a thalidomide derivative (e.g., lenalidomide).

General Chemotherapeutic agents considered for use in combination therapies include anastrozole (Arimidex®), bicalutamide (Casodex®), bleomycin sulfate (Blenoxane®), busulfan (Myleran®), busulfan injection (Busulfex®), capecitabine (Xeloda®), N4-pentoxycarbonyl-5-deoxy-5-fluorocytidine, carboplatin (Paraplatin®), carmustine (BiCNU®), chlorambucil (Leukeran®), cisplatin (Platinol®), cladribine (Leustatin®), cyclophosphamide (Cytoxan® or Neosar®), cytarabine, cytosine arabinoside (Cytosar-U®), cytarabine liposome injection (DepoCyt®), dacarbazine (DTIC-Dome®), dactinomycin (Actinomycin D, Cosmegan), daunorubicin hydrochloride (Cerubidine®), daunorubicin citrate liposome injection (DaunoXome®), dexamethasone, docetaxel (Taxotere®), doxorubicin hydrochloride (Adriamycin®, Rubex®), etoposide (Vepesid®), fludarabine phosphate (Fludara®), 5-fluorouracil (Adrucil®, Efudex®), flutamide (Eulexin®), tezacitibine, gemcitabine (difluorodeoxycitidine), hydroxyurea (Hydrea®), Idarubicin (Idamycin®), ifosfamide (IFEX®), irinotecan (Camptosar®), L-asparaginase (ELSPAR®), leucovorin calcium, melphalan (Alkeran®), 6-mercaptopurine (Purinethol®), methotrexate (Folex®), mitoxantrone (Novantrone®), mylotarg, paclitaxel (Taxol®), nab-paclitaxel (Abraxane®), phoenix (Yttrium90/MX-DTPA), pentostatin, polifeprosan 20 with carmustine implant (Gliadel®), tamoxifen citrate (Nolvadex®), teniposide (Vumon®), 6-thioguanine, thiotepa, tirapazamine (Tirazone®), topotecan hydrochloride for injection (Hycamptin®), vinblastine (Velban®), vincristine (Oncovin®), and vinorelbine (Navelbine®).

Treatment with a combination of a chemotherapeutic agent and a cell expressing a CAR molecule described herein can be used to treat a hematologic cancer described herein, e.g., AML. In embodiments, the combination of a chemotherapeutic agent and a CAR-expressing cell is useful for targeting, e.g., killing, cancer stem cells, e.g., leukemic stem cells, e.g., in subjects with AML. In embodiments, the combination of a chemotherapeutic agent and a CAR-expressing cell is useful for treating minimal residual disease (MRD). MRD refers to the small number of cancer cells that remain in a subject during treatment, e.g., chemotherapy, or after treatment. MRD is often a major cause for relapse. The present invention provides a method for treating cancer, e.g., MRD, comprising administering a chemotherapeutic agent in combination with a CAR-expressing cell, e.g., as described herein.

In an embodiment, the chemotherapeutic agent is administered prior to administration of the cell expressing a CAR molecule, e.g., a CAR molecule described herein. In chemotherapeutic regimens where more than one administration of the chemotherapeutic agent is desired, the chemotherapeutic regimen is initiated or completed prior to administration of a cell expressing a CAR molecule, e.g., a CAR molecule described herein. In embodiments, the chemotherapeutic agent is administered at least 1 day, 2 days, 3 days, 4 days, 5 days, 6 days, 7 days, 8 days, 9 days, 10 days, 11 days, 12 days, 13 days, 14 days, 15 days, 20 days, 25 days, or 30 days prior to administration of the cell expressing the CAR molecule. In embodiments, the chemotherapeutic regimen is initiated or completed at least 1 day, 2 days, 3 days, 4 days, 5 days, 6 days, 7 days, 8 days, 9 days, 10 days, 11 days, 12 days, 13 days, 14 days, 15 days, 20 days, 25 days, or 30 days prior to administration of the cell expressing the CAR molecule. In embodiments, the chemotherapeutic agent is a chemotherapeutic agent that increases expression of CD19, CD20, or CD22 on the cancer cells, e.g., the tumor cells, e.g., as compared to expression on normal or non-cancer cells. Expression can be determined, for example, by immunohistochemical staining or flow cytometry analysis. For example, the chemotherapeutic agent is cytarabine (Ara-C).

Anti-cancer agents of particular interest for combinations with the compounds of the present invention include: antimetabolites; drugs that inhibit either the calcium dependent phosphatase calcineurin or the p70S6 kinase FK506) or inhibit the p70S6 kinase; alkylating agents; mTOR inhibitors; immunomodulators; anthracyclines; vinca alkaloids; proteosome inhibitors; GITR agonists; protein tyrosine phosphatase inhibitors; a CDK4 kinase inhibitor; a BTK kinase inhibitor; a MKN kinase inhibitor; a DGK kinase inhibitor; or an oncolytic virus.

Exemplary antimetabolites include, without limitation, folic acid antagonists (also referred to herein as antifolates), pyrimidine analogs, purine analogs and adenosine deaminase inhibitors): methotrexate (Rheumatrex®, Trexall®), 5-fluorouracil (Adrucil®, Efudex®, Fluoroplex®), floxuridine (FUDF®), cytarabine (Cytosar-U®, Tarabine PFS), 6-mercaptopurine (Puri-Nethol®)), 6-thioguanine (Thioguanine Tabloid®), fludarabine phosphate (Fludara®), pentostatin (Nipent®), pemetrexed (Alimta®), raltitrexed (Tomudex®), cladribine (Leustatin®), clofarabine (Clofarex®, Clolar®), mercaptopurine (Puri-Nethol®), capecitabine (Xeloda®), nelarabine (Arranon®), azacitidine (Vidaza®) and gemcitabine (Gemzar®). Preferred antimetabolites include, e.g., 5-fluorouracil (Adrucil®, Efudex®, Fluoroplex®), floxuridine (FUDF®), capecitabine (Xeloda®), pemetrexed (Alimta®), raltitrexed (Tomudex®) and gemcitabine (Gemzar®).

Exemplary alkylating agents include, without limitation, nitrogen mustards, ethylenimine derivatives, alkyl sulfonates, nitrosoureas and triazenes): uracil mustard (Aminouracil Mustard®, Chlorethaminacil®, Demethyldopan®, Desmethyldopan®, Haemanthamine®, Nordopan®, Uracil nitrogen Mustard®, Uracillost®, Uracilmostaza®, Uramustin®, Uramustine®), chlormethine (Mustargen®), cyclophosphamide (Cytoxan®, Neosar®, Clafen®, Endoxan®, Procytox®, Revimmune™), ifosfamide (Mitoxana®), melphalan (Alkeran®), Chlorambucil (Leukeran®), pipobroman (Amedel®, Vercyte®), triethylenemelamine (Hemel®, Hexalen®, Hexastat®), triethylenethiophosphoramine, Temozolomide (Temodar®), thiotepa (Thioplex®), busulfan (Busilvex®, Myleran®), carmustine (BiCNU®), lomustine (CeeNU®), streptozocin (Zanosar®), and Dacarbazine (DTIC-Dome®). Additional exemplary alkylating agents include, without limitation, Oxaliplatin (Eloxatin®); Temozolomide (Temodar® and Temodal®); Dactinomycin (also known as actinomycin-D, Cosmegen®); Melphalan (also known as L-PAM, L-sarcolysin, and phenylalanine mustard, Alkeran®); Altretamine (also known as hexamethylmelamine (HMM), Hexalen®); Carmustine (BiCNU®); Bendamustine (Treanda®); Busulfan (Busulfex® and Myleran®); Carboplatin (Paraplatin®); Lomustine (also known as CCNU, CeeNU®); Cisplatin (also known as CDDP, Platinol® and Platinol®-AQ); Chlorambucil (Leukeran®); Cyclophosphamide (Cytoxan® and Neosar®); Dacarbazine (also known as DTIC, DIC and imidazole carboxamide, DTIC-Dome®); Altretamine (also known as hexamethylmelamine (HMM), Hexalen®); Ifosfamide (Ifex®); Prednumustine; Procarbazine (Matulane®); Mechlorethamine (also known as nitrogen mustard, mustine and mechloroethamine hydrochloride, Mustargen®); Streptozocin (Zanosar®); Thiotepa (also known as thiophosphoamide, TESPA and TSPA, Thioplex®); Cyclophosphamide (Endoxan®, Cytoxan®, Neosar®, Procytox®, Revimmune®); and Bendamustine HCl (Treanda®).

In embodiments, a CAR-expressing cell described herein is administered to a subject in combination with fludarabine, cyclophosphamide, and/or rituximab. In embodiments, a CAR-expressing cell described herein is administered to a subject in combination with fludarabine, cyclophosphamide, and rituximab (FCR). In embodiments, the subject has CLL. For example, the subject has a deletion in the short arm of chromosome 17 (del(17p), e.g., in a leukemic cell). In other examples, the subject does not have a del(17p). In embodiments, the subject comprises a leukemic cell comprising a mutation in the immunoglobulin heavy-chain variable-region (IgV$_H$) gene. In other embodiments, the subject does not comprise a leukemic cell comprising a mutation in the immunoglobulin heavy-chain variable-region (IgV$_H$) gene. In embodiments, the fludarabine is administered at a dosage of about 10-50 mg/m$^2$ (e.g., about 10-15, 15-20, 20-25, 25-30, 30-35, 35-40, 40-45, or 45-50 mg/m$^2$), e.g., intravenously. In embodiments, the cyclophosphamide is administered at a dosage of about 200-300 mg/m$^2$ (e.g., about 200-225, 225-250, 250-275, or 275-300 mg/m$^2$), e.g., intravenously. In embodiments, the rituximab is administered at a dosage of about 400-600 mg/m2 (e.g., 400-450, 450-500, 500-550, or 550-600 mg/m$^2$), e.g., intravenously.

In embodiments, a CAR-expressing cell described herein is administered to a subject in combination with bendamustine and rituximab. In embodiments, the subject has CLL. For example, the subject has a deletion in the short arm of chromosome 17 (del(17p), e.g., in a leukemic cell). In other examples, the subject does not have a del(17p). In embodiments, the subject comprises a leukemic cell comprising a mutation in the immunoglobulin heavy-chain variable-region (IgV$_H$) gene. In other embodiments, the subject does not comprise a leukemic cell comprising a mutation in the immunoglobulin heavy-chain variable-region (IgV$_H$) gene. In embodiments, the bendamustine is administered at a dosage of about 70-110 mg/m2 (e.g., 70-80, 80-90, 90-100, or 100-110 mg/m2), e.g., intravenously. In embodiments, the rituximab is administered at a dosage of about 400-600 mg/m2 (e.g., 400-450, 450-500, 500-550, or 550-600 mg/m$^2$), e.g., intravenously.

In embodiments, a CAR-expressing cell described herein is administered to a subject in combination with rituximab, cyclophosphamide, doxorubicine, vincristine, and/or a corticosteroid (e.g., prednisone). In embodiments, a CAR-expressing cell described herein is administered to a subject in combination with rituximab, cyclophosphamide, doxorubicine, vincristine, and prednisone (R-CHOP). In embodiments, the subject has diffuse large B-cell lymphoma (DLBCL). In embodiments, the subject has nonbulky limited-stage DLBCL (e.g., comprises a tumor having a size/diameter of less than 7 cm). In embodiments, the subject is treated with radiation in combination with the R-CHOP. For example, the subject is administered R-CHOP (e.g., 1-6 cycles, e.g., 1, 2, 3, 4, 5, or 6 cycles of R-CHOP), followed by radiation. In some cases, the subject is administered R-CHOP (e.g., 1-6 cycles, e.g., 1, 2, 3, 4, 5, or 6 cycles of R-CHOP) following radiation.

In embodiments, a CAR-expressing cell described herein is administered to a subject in combination with etoposide, prednisone, vincristine, cyclophosphamide, doxorubicin, and/or rituximab. In embodiments, a CAR-expressing cell described herein is administered to a subject in combination with etoposide, prednisone, vincristine, cyclophosphamide, doxorubicin, and rituximab (EPOCH-R). In embodiments, a CAR-expressing cell described herein is administered to a subject in combination with dose-adjusted EPOCH-R (DA-EPOCH-R). In embodiments, the subject has a B cell lymphoma, e.g., a Myc-rearranged aggressive B cell lymphoma.

In embodiments, a CAR-expressing cell described herein is administered to a subject in combination with rituximab and/or lenalidomide. Lenalidomide ((RS)-3-(4-Amino-1-oxo 1,3-dihydro-2H-isoindol-2-yl)piperidine-2,6-dione) is an immunomodulator. In embodiments, a CAR-expressing cell described herein is administered to a subject in combination with rituximab and lenalidomide. In embodiments, the subject has follicular lymphoma (FL) or mantle cell lymphoma (MCL). In embodiments, the subject has FL and has not previously been treated with a cancer therapy. In embodiments, lenalidomide is administered at a dosage of about 10-20 mg (e.g., 10-15 or 15-20 mg), e.g., daily. In embodiments, rituximab is administered at a dosage of about 350-550 mg/m$^2$ (e.g., 350-375, 375-400, 400-425, 425-450, 450-475, or 475-500 mg/m$^2$), e.g., intravenously.

Exemplary mTOR inhibitors include, e.g., temsirolimus; ridaforolimus (formally known as deferolimus, (1R,2R,4S)-4-[(2R)-2 [(1R,9S,12S,15R,16E,18R,19R,21R,23S,24E, 26E,28Z,30S,32S,35R)-1,18-dihydroxy-19,30-dimethoxy-15,17,21,23,29,35-hexamethyl-2,3,10,14,20-pentaoxo-11, 36-dioxa-4-azatricyclo[30.3.1.0$^{4,9}$]hexatriaconta-16,24,26, 28-tetraen-12-yl]propyl]-2-methoxycyclohexyl dimethylphosphinate, also known as AP23573 and MK8669, and described in PCT Publication No. WO 03/064383); everolimus (Afinitor® or RAD001); rapamycin (AY22989, Sirolimus®); simapimod (CAS 164301-51-3); emsirolimus, (5-{2,4-Bis[(3S)-3-methylmorpholin-4-yl]pyrido[2,3-d]pyrimidin-7-yl}-2-methoxyphenyl)methanol (AZD8055); 2-Amino-8-[trans-4-(2-hydroxyethoxy)cyclohexyl]-6-(6-methoxy-3-pyridinyl)-4-methyl-pyrido[2,3-d]pyrimidin-7(8H)-one (PF04691502, CAS 1013101-36-4); and N$^2$-[1,4-dioxo-4-[[4-(4-oxo-8-phenyl-4H-1-benzopyran-2-yl)morpholinium-4-yl]methoxy]butyl]-L-arginylglycyl-L-α-aspartylL-serine-, inner salt (SF1126, CAS 936487-67-1) (SEQ ID NO: 1316), and XL765.

Exemplary immunomodulators include, e.g., afutuzumab (available from Roche®); pegfilgrastim (Neulasta®); lenalidomide (CC-5013, Revlimid®); thalidomide (Thalomid®), actimid (CC4047); and IRX-2 (mixture of human cytokines including interleukin 1, interleukin 2, and interferon γ, CAS 951209-71-5, available from IRX Therapeutics).

Exemplary anthracyclines include, e.g., doxorubicin (Adriamycin® and Rubex®); bleomycin (Lenoxane®); daunorubicin (dauorubicin hydrochloride, daunomycin, and rubidomycin hydrochloride, Cerubidine®); daunorubicin liposomal (daunorubicin citrate liposome, DaunoXome®); mitoxantrone (DHAD, Novantrone®); epirubicin (Ellence™); idarubicin (Idamycin®, Idamycin PFS®); mitomycin C (Mutamycin®); geldanamycin; herbimycin; ravidomycin; and desacetylravidomycin.

Exemplary vinca alkaloids include, e.g., vinorelbine tartrate (Navelbine®), Vincristine (Oncovin®), and Vindesine (Eldisine®)); vinblastine (also known as vinblastine sulfate, vincaleukoblastine and VLB, Alkaban-AQ® and Velban®); and vinorelbine (Navelbine®).

Exemplary proteosome inhibitors include bortezomib (Velcade®); carfilzomib (PX-171-007, (S)-4-Methyl-N-((S)-1-(((S)-4-methyl-1-((R)-2-methyloxiran-2-yl)-1-oxopentan-2-yl)amino)-1-oxo-3-phenylpropan-2-yl)-2-((S)-2-(2-morpholinoacetamido)-4-phenylbutanamido)-pentanamide); marizomib (NPI-0052); ixazomib citrate (MLN-9708); delanzomib (CEP-18770); and O-Methyl-N-[(2-methyl-5-thiazolyl)carbonyl]-L-seryl-O-methyl-N-[(1S)-2-[(2R)-2-methyl-2-oxiranyl]-2-oxo-1-(phenylmethyl)ethyl]-L-serinamide (ONX-0912).

In embodiments, a CAR-expressing cell described herein is administered to a subject in combination with brentuximab. Brentuximab is an antibody-drug conjugate of anti-CD30 antibody and monomethyl auristatin E. In embodiments, the subject has Hodgkin's lymphoma (HL), e.g., relapsed or refractory HL. In embodiments, the subject comprises CD30+HL. In embodiments, the subject has undergone an autologous stem cell transplant (ASCT). In embodiments, the subject has not undergone an ASCT. In embodiments, brentuximab is administered at a dosage of about 1-3 mg/kg (e.g., about 1-1.5, 1.5-2, 2-2.5, or 2.5-3 mg/kg), e.g., intravenously, e.g., every 3 weeks.

In embodiments, a CAR-expressing cell described herein is administered to a subject in combination with brentuximab and dacarbazine or in combination with brentuximab and bendamustine. Dacarbazine is an alkylating agent with a chemical name of 5-(3,3-Dimethyl-1-triazenyl)imidazole-4-carboxamide. Bendamustine is an alkylating agent with a chemical name of 4-[5-[Bis(2-chloroethyl)amino]-1-methylbenzimidazol-2-yl]butanoic acid. In embodiments, the subject has Hodgkin's lymphoma (HL). In embodiments, the subject has not previously been treated with a cancer therapy. In embodiments, the subject is at least 60 years of age, e.g., 60, 65, 70, 75, 80, 85, or older. In embodiments, dacarbazine is administered at a dosage of about 300-450 mg/m$^2$ (e.g., about 300-325, 325-350, 350-375, 375-400, 400-425, or 425-450 mg/m$^2$), e.g., intravenously. In embodiments, bendamustine is administered at a dosage of about 75-125 mg/m2 (e.g., 75-100 or 100-125 mg/m$^2$, e.g., about 90 mg/m$^2$), e.g., intravenously. In embodiments, brentuximab is administered at a dosage of about 1-3 mg/kg (e.g., about 1-1.5, 1.5-2, 2-2.5, or 2.5-3 mg/kg), e.g., intravenously, e.g., every 3 weeks.

In some embodiments, a CAR-expressing cell described herein is administered to a subject in combination with a CD20 inhibitor, e.g., an anti-CD20 antibody (e.g., an anti-CD20 mono- or bispecific antibody) or a fragment thereof. Exemplary anti-CD20 antibodies include but are not limited to rituximab, ofatumumab, ocrelizumab, veltuzumab, obinutuzumab, TRU-015 (Trubion Pharmaceuticals), ocaratuzumab, and Pro131921 (Genentech). See, e.g., Lim et al. Haematologica. 95.1(2010):135-43.

In some embodiments, the anti-CD20 antibody comprises rituximab. Rituximab is a chimeric mouse/human monoclonal antibody IgG1 kappa that binds to CD20 and causes cytolysis of a CD20 expressing cell, e.g., as described in www.accessdata.fda.gov/drugsatfda_docs/label/2009/125326lbl.pdf. In embodiments, a CAR-expressing cell described herein is administered to a subject in combination with rituximab. In embodiments, the subject has CLL or SLL.

In some embodiments, rituximab is administered intravenously, e.g., as an intravenous infusion. For example, each infusion provides about 500-2000 mg (e.g., about 500-550, 550-600, 600-650, 650-700, 700-750, 750-800, 800-850, 850-900, 900-950, 950-1000, 1000-1100, 1100-1200, 1200-1300, 1300-1400, 1400-1500, 1500-1600, 1600-1700, 1700-1800, 1800-1900, or 1900-2000 mg) of rituximab. In some embodiments, rituximab is administered at a dose of 150 mg/m$^2$ to 750 mg/m$^2$, e.g., about 150-175 mg/m$^2$, 175-200 mg/m$^2$, 200-225 mg/m$^2$, 225-250 mg/m$^2$, 250-300 mg/m$^2$, 300-325 mg/m$^2$, 325-350 mg/m$^2$, 350-375 mg/m$^2$, 375-400 mg/m$^2$, 400-425 mg/m$^2$, 425-450 mg/m$^2$, 450-475 mg/m$^2$, 475-500 mg/m$^2$, 500-525 mg/m$^2$, 525-550 mg/m$^2$, 550-575 mg/m$^2$, 575-600 mg/m$^2$, 600-625 mg/m$^2$, 625-650 mg/m$^2$, 650-675 mg/m$^2$, or 675-700 mg/m$^2$, where m$^2$ indicates the body surface area of the subject. In some embodiments, rituximab is administered at a dosing interval of at least 4 days, e.g., 4, 7, 14, 21, 28, 35 days, or more. For example, rituximab is administered at a dosing interval of at least 0.5 weeks, e.g., 0.5, 1, 2, 3, 4, 5, 6, 7, 8 weeks, or more. In some embodiments, rituximab is administered at a dose and dosing interval described herein for a period of time, e.g., at least 2 weeks, e.g., at least 2, 3, 4, 5, 6, 7, 8, 9, 10, 11, 12, 13, 14, 15, 16, 17, 18, 19, 20 weeks, or greater. For example, rituximab is administered at a dose and dosing interval described herein for a total of at least 4 doses per treatment cycle (e.g., at least 4, 5, 6, 7, 8, 9, 10, 11, 12, 13, 14, 15, 16, or more doses per treatment cycle).

In some embodiments, the anti-CD20 antibody comprises ofatumumab. Ofatumumab is an anti-CD20 IgG1κ human monoclonal antibody with a molecular weight of approximately 149 kDa. For example, ofatumumab is generated using transgenic mouse and hybridoma technology and is expressed and purified from a recombinant murine cell line (NS0). See, e.g., www.accessdata.fda.gov/drugsatfda_docs/label/2013/125486s000lbl.pdf; and Clinical Trial Identifier number NCT01363128, NCT01515176, NCT01626352, and NCT01397591. In embodiments, a CAR-expressing cell described herein is administered to a subject in combination with ofatumumab. In embodiments, the subject has CLL or SLL.

In some embodiments, ofatumumab is administered as an intravenous infusion. For example, each infusion provides about 150-3000 mg (e.g., about 150-200, 200-250, 250-300, 300-350, 350-400, 400-450, 450-500, 500-550, 550-600, 600-650, 650-700, 700-750, 750-800, 800-850, 850-900, 900-950, 950-1000, 1000-1200, 1200-1400, 1400-1600, 1600-1800, 1800-2000, 2000-2200, 2200-2400, 2400-2600, 2600-2800, or 2800-3000 mg) of ofatumumab. In embodiments, ofatumumab is administered at a starting dosage of about 300 mg, followed by 2000 mg, e.g., for about 11 doses, e.g., for 24 weeks. In some embodiments, ofatumumab is administered at a dosing interval of at least 4 days, e.g., 4, 7, 14, 21, 28, 35 days, or more. For example, ofatumumab is administered at a dosing interval of at least 1 week, e.g., 1, 2, 3, 4, 5, 6, 7, 8, 9, 10, 11, 12, 24, 26, 28, 20, 22, 24, 26, 28, 30 weeks, or more. In some embodiments, ofatumumab is administered at a dose and dosing interval described herein for a period of time, e.g., at least 1 week, e.g., 1, 2, 3, 4, 5, 6, 7, 8, 9, 10, 11, 12, 13, 14, 15, 16, 17, 18, 19, 20, 22, 24, 26, 28, 30, 40, 50, 60 weeks or greater, or 1, 2, 3, 4, 5, 6, 7, 8, 9, 10, 11, 12 months or greater, or 1, 2, 3, 4, 5 years or greater. For example, ofatumumab is administered at a dose and dosing interval described herein for a total of at least 2 doses per treatment cycle (e.g., at least 2, 3, 4, 5, 6, 7, 8, 9, 10, 11, 12, 13, 14, 15, 16, 18, 20, or more doses per treatment cycle).

In some cases, the anti-CD20 antibody comprises ocrelizumab. Ocrelizumab is a humanized anti-CD20 monoclonal antibody, e.g., as described in Clinical Trials Identifier Nos. NCT00077870, NCT01412333, NCT00779220, NCT00673920, NCT01194570, and Kappos et al. Lancet. 19.378(2011):1779-87.

In some cases, the anti-CD20 antibody comprises veltuzumab. Veltuzumab is a humanized monoclonal antibody against CD20. See, e.g., Clinical Trial Identifier No. NCT00547066, NCT00546793, NCT01101581, and Goldenberg et al. Leuk Lymphoma. 51(5)(2010):747-55.

In some cases, the anti-CD20 antibody comprises GA101. GA101 (also called obinutuzumab or RO5072759) is a humanized and glyco-engineered anti-CD20 monoclonal antibody. See, e.g., Robak. Curr. Opin. Investig. Drugs. 10.6(2009):588-96; Clinical Trial Identifier Numbers: NCT01995669, NCT01889797, NCT02229422, and NCT01414205; and www.accessdata.fda.gov/drugsatfda_docs/label/2013/125486s000lbl.pdf.

In some cases, the anti-CD20 antibody comprises AME-133v. AME-133v (also called LY2469298 or ocaratuzumab) is a humanized IgG1 monoclonal antibody against CD20 with increased affinity for the FcγRIIIa receptor and an enhanced antibody dependent cellular cytotoxicity (ADCC) activity compared with rituximab. See, e.g., Robak et al. BioDrugs 25.1(2011):13-25; and Forero-Torres et al. Clin Cancer Res. 18.5(2012):1395-403.

In some cases, the anti-CD20 antibody comprises PRO131921. PRO131921 is a humanized anti-CD20 monoclonal antibody engineered to have better binding to FcγRIIIa and enhanced ADCC compared with rituximab. See, e.g., Robak et al. BioDrugs 25.1(2011):13-25; and Casulo et al. Clin Immunol. 154.1(2014):37-46; and Clinical Trial Identifier No. NCT00452127.

In some cases, the anti-CD20 antibody comprises TRU-015. TRU-015 is an anti-CD20 fusion protein derived from domains of an antibody against CD20. TRU-015 is smaller than monoclonal antibodies, but retains Fc-mediated effector functions. See, e.g., Robak et al. BioDrugs 25.1(2011):13-25. TRU-015 contains an anti-CD20 single-chain variable fragment (scFv) linked to human IgG1 hinge, CH2, and CH3 domains but lacks CH1 and CL domains.

In some embodiments, an anti-CD20 antibody described herein is conjugated or otherwise bound to a therapeutic agent, e.g., a chemotherapeutic agent (e.g., cytoxan, fludarabine, histone deacetylase inhibitor, demethylating agent, peptide vaccine, anti-tumor antibiotic, tyrosine kinase inhibitor, alkylating agent, anti-microtubule or anti-mitotic agent), anti-allergic agent, anti-nausea agent (or anti-emetic), pain reliever, or cytoprotective agent described herein.

In embodiments, a CAR-expressing cell described herein is administered to a subject in combination with a B-cell lymphoma 2 (BCL-2) inhibitor (e.g., venetoclax, also called ABT-199 or GDC-0199) and/or rituximab. In embodiments, a CAR-expressing cell described herein is administered to a subject in combination with venetoclax and rituximab. Venetoclax is a small molecule that inhibits the anti-apoptotic protein, BCL-2. The structure of venetoclax (4-(4-{[2-(4-chlorophenyl)-4,4-dimethylcyclohex-1-en-1-yl]methyl}piperazin-1-yl)-N-({3-nitro-4-[(tetrahydro-2H-pyran-4-ylmethyl)amino]phenyl}sulfonyl)-2-(1H-pyrrolo[2,3-b]pyridin-5-yloxy)benzamide) is shown below.

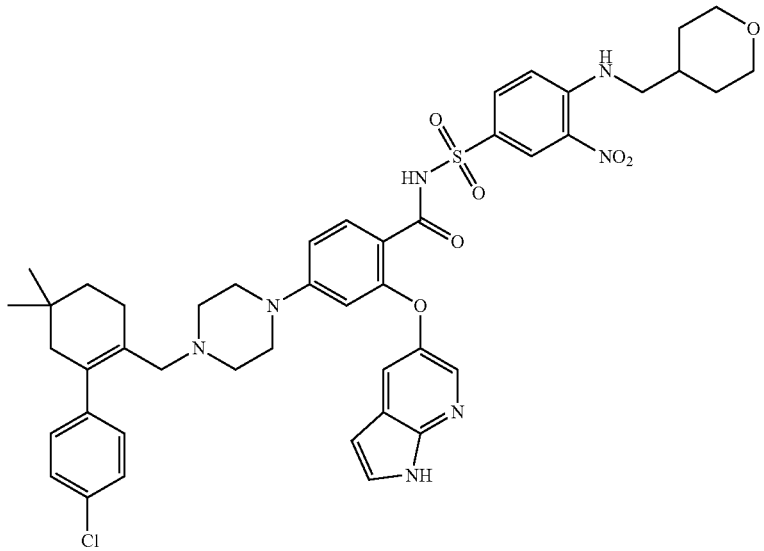 [SMILES: CC1(C)CCC(CN2CCN(c3ccc(C(=O)NS(=O)(=O)c4ccc(NCC5CCOCC5)c([N+](=O)[O-])c4)c(Oc4cnc5[nH]ccc5c4)c3)CC2)=C(c2ccc(Cl)cc2)C1]

In embodiments, the subject has CLL. In embodiments, the subject has relapsed CLL, e.g., the subject has previously been administered a cancer therapy. In embodiments, venetoclax is administered at a dosage of about 15-600 mg (e.g., 15-20, 20-50, 50-75, 75-100, 100-200, 200-300, 300-400, 400-500, or 500-600 mg), e.g., daily. In embodiments, rituximab is administered at a dosage of about 350-550 mg/m2 (e.g., 350-375, 375-400, 400-425, 425-450, 450-475, or 475-500 mg/m2), e.g., intravenously, e.g., monthly.

In some embodiments, one or more CAR-expressing cells described herein is administered in combination with an oncolytic virus. In embodiments, oncolytic viruses are capable of selectively replicating in and triggering the death of or slowing the growth of a cancer cell. In some cases, oncolytic viruses have no effect or a minimal effect on non-cancer cells. An oncolytic virus includes but is not limited to an oncolytic adenovirus, oncolytic Herpes Simplex Viruses, oncolytic retrovirus, oncolytic parvovirus, oncolytic vaccinia virus, oncolytic Sinbis virus, oncolytic influenza virus, or oncolytic RNA virus (e.g., oncolytic reovirus, oncolytic Newcastle Disease Virus (NDV), oncolytic measles virus, or oncolytic vesicular stomatitis virus (VSV)).

In some embodiments, the oncolytic virus is a virus, e.g., recombinant oncolytic virus, described in US2010/0178684 A1, which is incorporated herein by reference in its entirety. In some embodiments, a recombinant oncolytic virus comprises a nucleic acid sequence (e.g., heterologous nucleic acid sequence) encoding an inhibitor of an immune or inflammatory response, e.g., as described in US2010/0178684 A1, incorporated herein by reference in its entirety. In embodiments, the recombinant oncolytic virus, e.g., oncolytic NDV, comprises a pro-apoptotic protein (e.g., apoptin), a cytokine (e.g., GM-CSF, interferon-gamma, interleukin-2 (IL-2), tumor necrosis factor-alpha), an immunoglobulin (e.g., an antibody against ED-B firbonectin), tumor associated antigen, a bispecific adapter protein (e.g., bispecific antibody or antibody fragment directed against NDV HN protein and a T cell co-stimulatory receptor, such as CD3 or CD28; or fusion protein between human IL-2 and single chain antibody directed against NDV HN protein). See, e.g., Zamarin et al. Future Microbiol. 7.3(2012):347-67, incorporated herein by reference in its entirety. In some embodiments, the oncolytic virus is a chimeric oncolytic NDV described in U.S. Pat. No. 8,591,881 B2, US 2012/0122185 A1, or US 2014/0271677 A1, each of which is incorporated herein by reference in their entireties.

In some embodiments, the oncolytic virus comprises a conditionally replicative adenovirus (CRAd), which is designed to replicate exclusively in cancer cells. See, e.g., Alemany et al. Nature Biotechnol. 18(2000):723-27. In some embodiments, an oncolytic adenovirus comprises one described in Table 1 on page 725 of Alemany et al., incorporated herein by reference in its entirety.

Exemplary oncolytic viruses include but are not limited to the following:

Group B Oncolytic Adenovirus (ColoAd1) (PsiOxus Therapeutics Ltd.) (see, e.g., Clinical Trial Identifier: NCT02053220);

ONCOS-102 (previously called CGTG-102), which is an adenovirus comprising granulocyte-macrophage colony stimulating factor (GM-CSF) (Oncos Therapeutics) (see, e.g., Clinical Trial Identifier: NCT01598129);

VCN-01, which is a genetically modified oncolytic human adenovirus encoding human PH20 hyaluronidase (VCN Biosciences, S.L.) (see, e.g., Clinical Trial Identifiers: NCT02045602 and NCT02045589);

Conditionally Replicative Adenovirus ICOVIR-5, which is a virus derived from wild-type human adenovirus serotype 5 (HadS) that has been modified to selectively replicate in cancer cells with a deregulated retinoblastoma/E2F pathway (Institut Català d'Oncologia) (see, e.g., Clinical Trial Identifier: NCT01864759);

Celyvir, which comprises bone marrow-derived autologous mesenchymal stem cells (MSCs) infected with ICOVIR5, an oncolytic adenovirus (Hospital Infantil Universitario Niño Jesús, Madrid, Spain/Ramon Alemany) (see, e.g., Clinical Trial Identifier: NCT01844661);

CG0070, which is a conditionally replicating oncolytic serotype 5 adenovirus (Ad5) in which human E2F-1 promoter drives expression of the essential E1a viral genes, thereby restricting viral replication and cytotoxicity to Rb pathway-defective tumor cells (Cold Genesys, Inc.) (see, e.g., Clinical Trial Identifier: NCT02143804); or DNX-2401 (formerly named Delta-24-RGD), which is an adenovirus that has been engineered to replicate selectively in retinoblastoma (Rb)-pathway deficient cells and to infect cells that express certain RGD-binding integrins more efficiently (Clinica Universidad de Navarra, Universidad de Navarra/DNAtrix, Inc.) (see, e.g., Clinical Trial Identifier: NCT01956734).

In some embodiments, an oncolytic virus described herein is administering by injection, e.g., subcutaneous, intra-arterial, intravenous, intramuscular, intrathecal, or intraperitoneal injection. In embodiments, an oncolytic virus described herein is administered intratumorally, transdermally, transmucosally, orally, intranasally, or via pulmonary administration.

In an embodiment, cells expressing a CAR described herein are administered to a subject in combination with a molecule that decreases the Treg cell population. Methods that decrease the number of (e.g., deplete) Treg cells are known in the art and include, e.g., CD25 depletion, cyclophosphamide administration, modulating GITR function. Without wishing to be bound by theory, it is believed that reducing the number of Treg cells in a subject prior to apheresis or prior to administration of a CAR-expressing cell described herein reduces the number of unwanted immune cells (e.g., Tregs) in the tumor microenvironment and reduces the subject's risk of relapse.

In an embodiment, a CAR-expressing cell described herein is administered to a subject in combination with a molecule that decreases the Treg cell population. Methods that decrease the number of (e.g., deplete) Treg cells are known in the art and include, e.g., CD25 depletion, cyclophosphamide administration, and modulating GITR function. Without wishing to be bound by theory, it is believed that reducing the number of Treg cells in a subject prior to apheresis or prior to administration of a CAR-expressing cell described herein reduces the number of unwanted immune cells (e.g., Tregs) in the tumor microenvironment and reduces the subject's risk of relapse. In one embodiment, CAR-expressing cells described herein are administered to a subject in combination with a molecule targeting GITR and/or modulating GITR functions, such as a GITR agonist and/or a GITR antibody that depletes regulatory T cells (Tregs). In one embodiment, CAR-expressing cells described herein are administered to a subject in combination with cyclophosphamide. In one embodiment, the GITR binding molecule and/or molecule modulating GITR function (e.g., GITR agonist and/or Treg depleting GITR antibodies) is administered prior to the CAR-expressing cells. For example, in one embodiment, the GITR agonist can be administered prior to apheresis of the cells. In embodiments, cyclophosphamide is administered to the subject prior to administration (e.g., infusion or re-infusion) of the CAR-expressing cell or prior to apheresis of the cells. In embodiments, cyclophosphamide and an anti-GITR antibody are administered to the subject prior to administration (e.g., infusion or re-infusion) of the CAR-expressing cell or prior to apheresis of the cells. In one embodiment, the subject has cancer (e.g., a solid cancer or a hematological cancer such as ALL or CLL). In one embodiment, the subject has CLL. In embodiments, the subject has a solid cancer, e.g., a solid cancer described herein.

In one embodiment, the combination of a CD19 CAR expressing cell described herein and one or more B-cell inhibitor described herein is administered to a subject in combination with a GITR agonist, e.g., a GITR agonist described herein. In one embodiment, the GITR agonist is administered prior to the CAR-expressing cell, e.g., CD19 CAR-expressing cells. For example, in one embodiment, the GITR agonist can be administered prior to apheresis of the cells. In one embodiment, the subject has CLL.

In one embodiment, a CAR expressing cell described herein is administered to a subject in combination with a GITR agonist, e.g., a GITR agonist described herein. In one embodiment, the GITR agonist is administered prior to the CAR-expressing cell. For example, in one embodiment, the GITR agonist can be administered prior to apheresis of the cells.

Exemplary GITR agonists include, e.g., GITR fusion proteins and anti-GITR antibodies (e.g., bivalent anti-GITR antibodies) such as, e.g., a GITR fusion protein described in U.S. Pat. No. 6,111,090, European Patent No.: 090505B1, U.S. Pat. No. 8,586,023, PCT Publication Nos.: WO 2010/003118 and 2011/090754, or an anti-GITR antibody described, e.g., in U.S. Pat. No. 7,025,962, European Patent No.: 1947183B1, U.S. Pat. Nos. 7,812,135, 8,388,967, 8,591,886, European Patent No.: EP 1866339, PCT Publication No.: WO 2011/028683, PCT Publication No.: WO 2013/039954, PCT Publication No.: WO2005/007190, PCT Publication No.: WO 2007/133822, PCT Publication No.: WO2005/055808, PCT Publication No.: WO 99/40196, PCT Publication No.: WO 2001/03720, PCT Publication No.: WO99/20758, PCT Publication No.: WO2006/083289, PCT Publication No.: WO 2005/115451, U.S. Pat. No. 7,618,632, and PCT Publication No.: WO 2011/051726.

In one embodiment, a CAR expressing cell described herein is administered to a subject in combination with a protein tyrosine phosphatase inhibitor, e.g., a protein tyrosine phosphatase inhibitor described herein. In one embodiment, the protein tyrosine phosphatase inhibitor is an SHP-1 inhibitor, e.g., an SHP-1 inhibitor described herein, such as, e.g., sodium stibogluconate. In one embodiment, the protein tyrosine phosphatase inhibitor is an SHP-2 inhibitor, e.g., an SHP-2 inhibitor described herein.

In one embodiment, a CAR-expressing cell described herein optionally in combination with one or more B-cell inhibitor can be used in combination with a kinase inhibitor. In one embodiment, the kinase inhibitor is a CDK4 inhibitor, e.g., a CDK4 inhibitor described herein, e.g., a CD4/6 inhibitor, such as, e.g., 6-Acetyl-8-cyclopentyl-5-methyl-2-(5-piperazin-1-yl-pyridin-2-ylamino)-8H-pyrido[2,3-d]pyrimidin-7-one, hydrochloride (also referred to as palbociclib or PD0332991). In one embodiment, the kinase inhibitor is a BTK inhibitor, e.g., a BTK inhibitor described herein, such as, e.g., ibrutinib. In one embodiment, the kinase inhibitor is an mTOR inhibitor, e.g., an mTOR inhibitor described herein, such as, e.g., rapamycin, a rapamycin analog, OSI-027. The mTOR inhibitor can be, e.g., an mTORC1 inhibitor and/or an mTORC2 inhibitor, e.g., an mTORC1 inhibitor and/or mTORC2 inhibitor described herein. In one embodiment, the kinase inhibitor is a MNK inhibitor, e.g., a MNK inhibitor described herein, such as, e.g., 4-amino-5-(4-fluoroanilino)-pyrazolo[3,4-d]pyrimidine. The MNK inhibitor can be, e.g., a MNK1a, MNK1b, MNK2a and/or MNK2b inhibitor.

In one embodiment, the kinase inhibitor is a CDK4 inhibitor selected from aloisine A; flavopiridol or HMR-1275, 2-(2-chlorophenyl)-5,7-dihydroxy-8-[(3S,4R)-3-hydroxy-1-methyl-4-piperidinyl]-4-chromenone; crizotinib (PF-02341066; 2-(2-Chlorophenyl)-5,7-dihydroxy-8-[(2R,3S)-2-(hydroxymethyl)-1-methyl-3-pyrrolidinyl]-4H-1-benzopyran-4-one, hydrochloride (P276-00); 1-methyl-5-[[2-[5-(trifluoromethyl)-1H-imidazol-2-yl]-4-pyridinyl]oxy]-N-[4-(trifluoromethyl)phenyl]-1H-benzimidazol-2-amine (RAF265); indisulam (E7070); roscovitine (CYC202); palbociclib (PD0332991); dinaciclib (SCH727965); N-[5-[[(5-tert-butyloxazol-2-yl)methyl]thio]thiazol-2-yl]piperidine-4-carboxamide (BMS 387032); 4-[[9-chloro-7-(2,6-difluorophenyl)-5H-pyrimido[5,4-d][2]benzazepin-2-yl]amino]-benzoic acid (MLN8054); 5-[3-(4,6-difluoro-1H-benzimidazol-2-yl)-1H-indazol-5-yl]-N-ethyl-4-methyl-3-pyridinemethanamine (AG-024322); 4-(2,6-dichlorobenzoylamino)-1H-pyrazole-3-carboxylic acid N-(piperidin-4-yl)amide (AT7519); 4-[2-methyl-1-(1-methylethyl)-1H-imidazol-5-yl]-N-[4-(methylsulfonyl)phenyl]-2-pyrimidinamine (AZD5438); and XL281 (BMS908662).

In one embodiment, the kinase inhibitor is a CDK4 inhibitor, e.g., palbociclib (PD0332991), and the palbociclib is administered at a dose of about 50 mg, 60 mg, 70 mg, 75 mg, 80 mg, 90 mg, 100 mg, 105 mg, 110 mg, 115 mg, 120 mg, 125 mg, 130 mg, 135 mg (e.g., 75 mg, 100 mg or 125 mg) daily for a period of time, e.g., daily for 14-21 days of a 28 day cycle, or daily for 7-12 days of a 21 day cycle. In one embodiment, 1, 2, 3, 4, 5, 6, 7, 8, 9, 10, 11, 12 or more cycles of palbociclib are administered.

In embodiments, a CAR-expressing cell described herein is administered to a subject in combination with a cyclin-dependent kinase (CDK) 4 or 6 inhibitor, e.g., a CDK4 inhibitor or a CDK6 inhibitor described herein. In embodiments, a CAR-expressing cell described herein is administered to a subject in combination with a CDK4/6 inhibitor (e.g., an inhibitor that targets both CDK4 and CDK6), e.g., a CDK4/6 inhibitor described herein. In an embodiment, the subject has MCL. MCL is an aggressive cancer that is poorly responsive to currently available therapies, i.e., essentially incurable. In many cases of MCL, cyclin D1 (a regulator of CDK4/6) is expressed (e.g., due to chromosomal translocation involving immunoglobulin and Cyclin D1 genes) in MCL cells. Thus, without being bound by theory, it is thought that MCL cells are highly sensitive to CDK4/6 inhibition with high specificity (i.e., minimal effect on normal immune cells). CDK4/6 inhibitors alone have had some efficacy in treating MCL, but have only achieved partial remission with a high relapse rate. An exemplary CDK4/6 inhibitor is LEE011 (also called ribociclib), the structure of which is shown below.

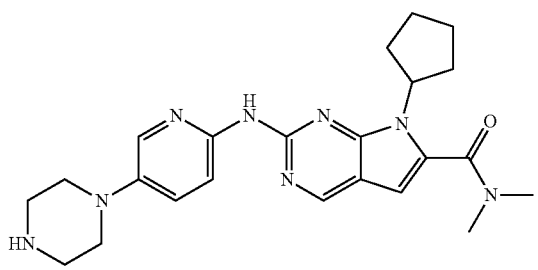 [SMILES: CN(C)C(=O)c1cc2cnc(Nc3ccc(N4CCNCC4)cn3)nc2n1C1CCCC1]

Without being bound by theory, it is believed that administration of a CAR-expressing cell described herein with a CDK4/6 inhibitor (e.g., LEE011 or other CDK4/6 inhibitor described herein) can achieve higher responsiveness, e.g., with higher remission rates and/or lower relapse rates, e.g., compared to a CDK4/6 inhibitor alone.

In one embodiment, the kinase inhibitor is a BTK inhibitor selected from ibrutinib (PCI-32765); GDC-0834; RN-486; CGI-560; CGI-1764; HM-71224; CC-292; ONO-4059; CNX-774; and LFM-A13. In an embodiment, the BTK inhibitor does not reduce or inhibit the kinase activity of interleukin-2-inducible kinase (ITK), and is selected from GDC-0834; RN-486; CGI-560; CGI-1764; HM-71224; CC-292; ONO-4059; CNX-774; and LFM-A13.

In one embodiment, the kinase inhibitor is a BTK inhibitor, e.g., ibrutinib (PCI-32765). In embodiments, a CAR-expressing cell described herein is administered to a subject in combination with a BTK inhibitor (e.g., ibrutinib). In embodiments, a CAR-expressing cell described herein is administered to a subject in combination with ibrutinib (also called PCI-32765). The structure of ibrutinib (1-[(3R)-3-[4-Amino-3-(4-phenoxyphenyl)-1H-pyrazolo[3,4-d]pyrimidin-1-yl]piperidin-1-yl]prop-2-en-1-one) is shown below.

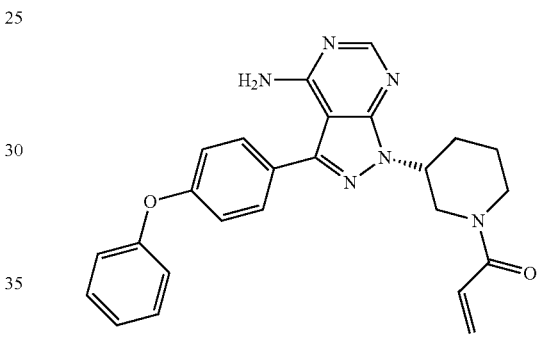

In embodiments, the subject has CLL, mantle cell lymphoma (MCL), or small lymphocytic lymphoma (SLL). For example, the subject has a deletion in the short arm of chromosome 17 (del(17p), e.g., in a leukemic cell). In other examples, the subject does not have a del(17p). In embodiments, the subject has relapsed CLL or SLL, e.g., the subject has previously been administered a cancer therapy (e.g., previously been administered one, two, three, or four prior cancer therapies). In embodiments, the subject has refractory CLL or SLL. In other embodiments, the subject has follicular lymphoma, e.g., relapse or refractory follicular lymphoma. In one embodiment, the kinase inhibitor is a BTK inhibitor, e.g., ibrutinib (PCI-32765), and the ibrutinib is administered at a dose of about 250 mg, 300 mg, 350 mg, 400 mg, 420 mg, 440 mg, 460 mg, 480 mg, 500 mg, 520 mg, 540 mg, 560 mg, 580 mg, 600 mg (e.g., 250 mg, 420 mg or 560 mg) daily for a period of time, e.g., daily for 21 day cycle, or daily for 28 day cycle. In one embodiment, 1, 2, 3, 4, 5, 6, 7, 8, 9, 10, 11, 12 or more cycles of ibrutinib are administered. In some embodiments, ibrutinib is administered in combination with rituximab. See, e.g., Burger et al. (2013) Ibrutinib In Combination With Rituximab (iR) Is Well Tolerated and Induces a High Rate Of Durable Remissions In Patients With High-Risk Chronic Lymphocytic Leukemia (CLL): New, Updated Results Of a Phase II Trial In 40 Patients, Abstract 675 presented at 55th ASH Annual Meeting and Exposition, New Orleans, La. 7-10 December. Without being bound by theory, it is thought that the addition of ibrutinib enhances the T cell proliferative response and may shift T cells from a T-helper-2 (Th2) to T-helper-1 (Th1) phenotype. Th1 and Th2 are phenotypes of helper T cells, with Th1 versus Th2 directing different immune response pathways. A Th1 phenotype is associated with proinflammatory responses, e.g., for killing cells, such as intracellular pathogens/viruses or cancerous cells, or perpetuating autoimmune responses. A Th2 phenotype is associated with eosinophil accumulation and anti-inflammatory responses. In some embodiments of the methods, uses, and compositions herein, the BTK inhibitor is a BTK inhibitor described in International Application WO/2015/079417, which is herein incorporated by reference in its entirety. For instance, in some embodiments, the BTK inhibitor is a compound of formula (I) or a pharmaceutically acceptable salt thereof;

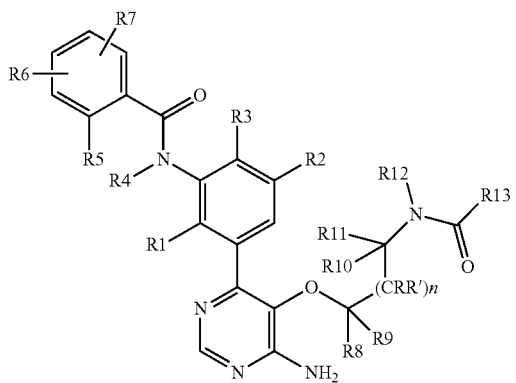

(I)

wherein,
R1 is hydrogen, C1-C6 alkyl optionally substituted by hydroxy;
R2 is hydrogen or halogen;
R3 is hydrogen or halogen;
R4 is hydrogen;
R5 is hydrogen or halogen;
or R4 and R5 are attached to each other and stand for a bond, —CH2—, —CH2—CH2—, —CH=CH—, —CH=CH—CH2—; —CH2—CH=CH—; or —CH2—CH2—CH2—;
R6 and R7 stand independently from each other for H, C1-C6 alkyl optionally substituted by hydroxyl, C3-C6 cycloalkyl optionally substituted by halogen or hydroxy, or halogen;
R8, R9, R, R', R10 and R11 independently from each other stand for H, or C1-C6 alkyl optionally substituted by C1-C6 alkoxy; or any two of R8, R9, R, R', R10 and R11 together with the carbon atom to which they are bound may form a 3-6 membered saturated carbocyclic ring;
R12 is hydrogen or C1-C6 alkyl optionally substituted by halogen or C1-C6 alkoxy;
or R12 and any one of R8, R9, R, R', R10 or R11 together with the atoms to which they are bound may form a 4, 5, 6 or 7 membered azacyclic ring, which ring may optionally be substituted by halogen, cyano, hydroxyl, C1-C6 alkyl or C1-C6 alkoxy;
n is 0 or 1; and
R13 is C2-C6 alkenyl optionally substituted by C1-C6 alkyl, C1-C6 alkoxy or N,N-di-C1-C6 alkyl amino; C2-C6 alkynyl optionally substituted by C1-C6 alkyl or C1-C6 alkoxy; or C2-C6 alkylenyl oxide optionally substituted by C1-C6 alkyl.

In some embodiments, the BTK inhibitor of Formula I is chosen from: N-(3-(5-((1-Acryloylazetidin-3-yl)oxy)-6-aminopyrimidin-4-yl)-5-fluoro-2-methylphenyl)-4-cyclopropyl-2-fluorobenzamide; (E)-N-(3-(6-Amino-5-((1-(but-2-enoyl)azetidin-3-yl)oxy)pyrimidin-4-yl)-5-fluoro-2-methylphenyl)-4-cyclopropyl-2-fluorobenzamide; N-(3-(6-Amino-5-((1-propioloylazetidin-3-yl)oxy)pyrimidin-4-yl)-5-fluoro-2-methylphenyl)-4-cyclopropyl-2-fluorobenzamide; N-(3-(6-Amino-5-((1-(but-2-ynoyl)azetidin-3-yl)oxy)pyrimidin-4-yl)-5-fluoro-2-methylphenyl)-4-cyclopropyl-2-fluorobenzamide; N-(3-(5-((1-Acryloylpiperidin-4-yl)oxy)-6-aminopyrimidin-4-yl)-5-fluoro-2-methylphenyl)-4-cyclopropyl-2-fluorobenzamide; N-(3-(6-Amino-5-(2-(N-methylacrylamido)ethoxy)pyrimidin-4-yl)-5-fluoro-2-methylphenyl)-4-cyclopropyl-2-fluorobenzamide; (E)-N-(3-(6-Amino-5-(2-(N-methylbut-2-enamido)ethoxy)pyrimidin-4-yl)-5-fluoro-2-methylphenyl)-4-cyclopropyl-2-fluorobenzamide; N-(3-(6-Amino-5-(2-(N-methylpropiolamido)ethoxy)pyrimidin-4-yl)-5-fluoro-2-methylphenyl)-4-cyclopropyl-2-fluorobenzamide; (E)-N-(3-(6-Amino-5-(2-(4-methoxy-N-methylbut-2-enamido)ethoxy)pyrimidin-4-yl)-5-fluoro-2-methylphenyl)-4-cyclopropyl-2-fluorobenzamide; N-(3-(6-Amino-5-(2-(N-methylbut-2-ynamido)ethoxy)pyrimidin-4-yl)-5-fluoro-2-methylphenyl)-4-cyclopropyl-2-fluorobenzamide; N-(2-((4-Amino-6-(3-(4-cyclopropyl-2-fluorobenzamido)-5-fluoro-2-methylphenyl)pyrimidin-5-yl)oxy)ethyl)-N-methyloxirane-2-carboxamide; N-(2-((4-Amino-6-(3-(6-cyclopropyl-8-fluoro-1-oxoisoquinolin-2(1H)-yl)phenyl)pyrimidin-5-yl)oxy)ethyl)-N-methylacrylamide; N-(3-(5-(2-Acrylamidoethoxy)-6-aminopyrimidin-4-yl)-5-fluoro-2-methylphenyl)-4-cyclopropyl-2-fluorobenzamide; N-(3-(6-Amino-5-(2-(N-ethylacrylamido)ethoxy)pyrimidin-4-yl)-5-fluoro-2-methylphenyl)-4-cyclopropyl-2-fluorobenzamide; N-(3-(6-Amino-5-(2-(N-(2-fluoroethyl)acrylamido)ethoxy)pyrimidin-4-yl)-5-fluoro-2-methylphenyl)-4-cyclopropyl-2-fluorobenzamide; N-(3-(5-((1-Acrylamidocyclopropyl)methoxy)-6-aminopyrimidin-4-yl)-5-fluoro-2-methylphenyl)-4-cyclopropyl-2-fluorobenzamide; (S)-N-(3-(5-(2-Acrylamidopropoxy)-6-aminopyrimidin-4-yl)-5-fluoro-2-methylphenyl)-4-cyclopropyl-2-fluorobenzamide; (S)-N-(3-(6-Amino-5-(2-(but-2-ynamido)propoxy)pyrimidin-4-yl)-5-fluoro-2-methylphenyl)-4-cyclopropyl-2-fluorobenzamide; (S)-N-(3-(6-Amino-5-(2-(N-methylacrylamido)propoxy)pyrimidin-4-yl)-5-fluoro-2-methylphenyl)-4-cyclopropyl-2-fluorobenzamide; (S)-N-(3-(6-Amino-5-(2-(N-methylbut-2-ynamido)propoxy)pyrimidin-4-yl)-5-fluoro-2-methylphenyl)-4-cyclopropyl-2-fluorobenzamide; N-(3-(6-Amino-5-(3-(N-methylacrylamido)propoxy)pyrimidin-4-yl)-5-fluoro-2-methylphenyl)-4-cyclopropyl-2-fluorobenzamide; (S)-N-(3-(5-((1-Acryloylpyrrolidin-2-yl)methoxy)-6-aminopyrimidin-4-yl)-5-fluoro-2-methylphenyl)-4-cyclopropyl-2-fluorobenzamide; (S)-N-(3-(6-Amino-5-((1-(but-2-ynoyl)pyrrolidin-2-yl)methoxy)pyrimidin-4-yl)-5-fluoro-2-methylphenyl)-4-cyclopropyl-2-fluorobenzamide; (S)-2-(3-(5-((1-Acryloylpyrrolidin-2-yl)methoxy)-6-aminopyrimidin-4-yl)-5-fluoro-2-(hydroxymethyl)phenyl)-6-cyclopropyl-3,4-dihydroisoquinolin-1(2H)-one; N-(2-((4-Amino-6-(3-(6-cyclopropyl-1-oxo-3,4-dihydroisoquinolin-2(1H)-yl)-5-fluoro-2-(hydroxymethyl)phenyl)pyrimidin-5-yl)oxy)ethyl)-N-methylacrylamide; N-(3-(5-(((2S,4R)-1-Acryloyl-4-methoxypyrrolidin-2-yl)methoxy)-6-aminopyrimidin-4-yl)-5-fluoro-2-methylphenyl)-4-cyclopropyl-2-fluorobenzamide; N-(3-(6-Amino-5-(((2S,4R)-1-(but-2-ynoyl)-4-methoxypyrrolidin-2-yl)methoxy)pyrimidin-4-yl)-5-fluoro-2-methylphenyl)-4-cyclopropyl-2- fluorobenzamide; 2-(3-(5-(((2S,4R)-1-Acryloyl-4-methoxypyrrolidin-2-yl)methoxy)-6-aminopyrimidin-4-yl)-5-fluoro-2-(hydroxymethyl)phenyl)-6-cyclopropyl-3,4-dihydroisoquinolin-1(2H)-one; N-(3-(5-(((2S,4S)-1-Acryloyl-4-methoxypyrrolidin-2-yl)methoxy)-6-aminopyrimidin-4-yl)-5-fluoro-2-methylphenyl)-4-cyclopropyl-2-fluorobenzamide; N-(3-(6-Amino-5-(((2S,4S)-1-(but-2-ynoyl)-4-methoxypyrrolidin-2-yl)methoxy)pyrimidin-4-yl)-5-fluoro-2-methylphenyl)-4-cyclopropyl-2-fluorobenzamide; N-(3-(5-(((2S,4R)-1-Acryloyl-4-fluoropyrrolidin-2-yl)methoxy)-6-aminopyrimidin-4-yl)-5-fluoro-2-methylphenyl)-4-cyclopropyl-2-fluorobenzamide; N-(3-(6-Amino-5-(((2S,4R)-1-(but-2-ynoyl)-4-fluoropyrrolidin-2-yl)methoxy)pyrimidin-4-yl)-5-fluoro-2-methylphenyl)-4-cyclopropyl-2-fluorobenzamide; (S)-N-(3-(5-((1-Acryloylazetidin-2-yl)methoxy)-6-aminopyrimidin-4-yl)-5-fluoro-2-methylphenyl)-4-cyclopropyl-2-fluorobenzamide; (S)-N-(3-(6-Amino-5-((1-propioloylazetidin-2-yl)methoxy)pyrimidin-4-yl)-5-fluoro-2-methylphenyl)-4-cyclopropyl-2-fluorobenzamide; (S)-2-(3-(5-((1-Acryloylazetidin-2-yl)methoxy)-6-aminopyrimidin-4-yl)-5-fluoro-2-(hydroxymethyl)phenyl)-6-cyclopropyl-3,4-dihydroisoquinolin-1(2H)-one; (R)-N-(3-(5-((1-Acryloylazetidin-2-yl)methoxy)-6-aminopyrimidin-4-yl)-5-fluoro-2-methylphenyl)-4-cyclopropyl-2-fluorobenzamide; (R)-N-(3-(5-((1-Acryloylpiperidin-3-yl)methoxy)-6-aminopyrimidin-4-yl)-5-fluoro-2-methylphenyl)-4-cyclopropyl-2-fluorobenzamide; N-(3-(5-(((2R,3S)-1-Acryloyl-3-methoxypyrrolidin-2-yl)methoxy)-6-aminopyrimidin-4-yl)-5-fluoro-2-methylphenyl)-4-cyclopropyl-2-fluorobenzamide; N-(3-(5-(((2S,4R)-1-Acryloyl-4-cyanopyrrolidin-2-yl)methoxy)-6-aminopyrimidin-4-yl)-5-fluoro-2-methylphenyl)-4-cyclopropyl-2-fluorobenzamide; or N-(3-(5-(((2S,4S)-1-Acryloyl-4-cyanopyrrolidin-2-yl)methoxy)-6-aminopyrimidin-4-yl)-5-fluoro-2-methylphenyl)-4-cyclopropyl-2-fluorobenzamide.

Unless otherwise provided, the chemical terms used above in describing the BTK inhibitor of Formula I are used according to their meanings as set out in International Application WO/2015/079417, which is herein incorporated by reference in its entirety.

In one embodiment, the kinase inhibitor is an mTOR inhibitor selected from temsirolimus; ridaforolimus (1R,2R,4S)-4-[(2R)-2 [(1R,9S,12S,15R,16E,18R,19R,21R,23S,24E,26E,28Z,30S,32S,35R)-1,18-dihydroxy-19,30-dimethoxy-15,17,21,23,29,35-hexamethyl-2,3,10,14,20-pentaoxo-11,36-dioxa-4-azatricyclo[30.3.1.0$^{4,9}$] hexatriaconta-16,24,26,28-tetraen-12-yl]propyl]-2-methoxycyclohexyl dimethylphosphinate, also known as AP23573 and MK8669; everolimus (RAD001); rapamycin (AY22989); simapimod; (5-{2,4-bis[(3S)-3-methylmorpholin-4-yl]pyrido[2,3-d]pyrimidin-7-yl}-2-methoxyphenyl) methanol (AZD8055); 2-amino-8-[trans-4-(2-hydroxyethoxy)cyclohexyl]-6-(6-methoxy-3-pyridinyl)-4-methylpyrido[2,3-d]pyrimidin-7(8H)-one (PF04691502); and N$^2$-[1,4-dioxo-4-[[4-(4-oxo-8-phenyl-4H-1-benzopyran-2-yl)morpholinium-4-yl]methoxy]butyl]-L-arginylglycyl-L-α-aspartylL-serine-, inner salt (SF1126) (SEQ ID NO: 1316); and XL765.

In one embodiment, the kinase inhibitor is an mTOR inhibitor, e.g., rapamycin, and the rapamycin is administered at a dose of about 3 mg, 4 mg, 5 mg, 6 mg, 7 mg, 8 mg, 9 mg, 10 mg (e.g., 6 mg) daily for a period of time, e.g., daily for 21 day cycle, or daily for 28 day cycle. In one embodiment, 1, 2, 3, 4, 5, 6, 7, 8, 9, 10, 11, 12 or more cycles of rapamycin are administered. In one embodiment, the kinase inhibitor is an mTOR inhibitor, e.g., everolimus and the everolimus is administered at a dose of about 2 mg, 2.5 mg, 3 mg, 4 mg, 5 mg, 6 mg, 7 mg, 8 mg, 9 mg, 10 mg, 11 mg, 12 mg, 13 mg, 14 mg, 15 mg (e.g., 10 mg) daily for a period of time, e.g., daily for 28 day cycle. In one embodiment, 1, 2, 3, 4, 5, 6, 7, 8, 9, 10, 11, 12 or more cycles of everolimus are administered.

In one embodiment, the kinase inhibitor is an MNK inhibitor selected from CGP052088; 4-amino-3-(p-fluorophenylamino)-pyrazolo[3,4-d]pyrimidine (CGP57380); cercosporamide; ETC-1780445-2; and 4-amino-5-(4-fluoroanilino)-pyrazolo[3,4-d]pyrimidine.

In embodiments, a CAR-expressing cell described herein is administered to a subject in combination with a phosphoinositide 3-kinase (PI3K) inhibitor (e.g., a PI3K inhibitor described herein, e.g., idelalisib or duvelisib) and/or rituximab. In embodiments, a CAR-expressing cell described herein is administered to a subject in combination with idelalisib and rituximab. In embodiments, a CAR-expressing cell described herein is administered to a subject in combination with duvelisib and rituximab. Idelalisib (also called GS-1101 or CAL-101; Gilead) is a small molecule that blocks the delta isoform of PI3K. The structure of idelalisib (5-Fluoro-3-phenyl-2-[(1S)-1-(7H-purin-6-ylamino)propyl]-4(3H)-quinazolinone) is shown below.

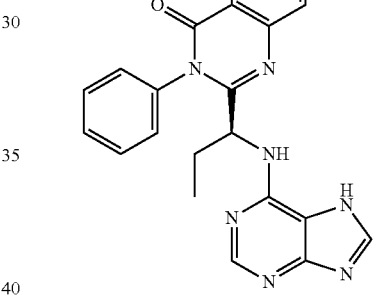

Duvelisib (also called IPI-145; Infinity Pharmaceuticals and Abbvie) is a small molecule that blocks PI3K-δ,γ. The structure of duvelisib (8-Chloro-2-phenyl-3-[(1S)-1-(9H-purin-6-ylamino)ethyl]-1(2H)-isoquinolinone) is shown below.

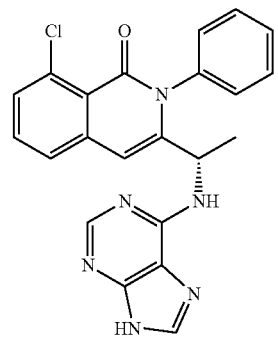 [SMILES: C[C@H](Nc1ncnc2[nH]cnc12)c1cc2cccc(Cl)c2c(=O)n1-c1ccccc1]

In embodiments, the subject has CLL. In embodiments, the subject has relapsed CLL, e.g., the subject has previously been administered a cancer therapy (e.g., previously been administered an anti-CD20 antibody or previously been administered ibrutinib). For example, the subject has a deletion in the short arm of chromosome 17 (del(17p), e.g., in a leukemic cell). In other examples, the subject does not have a del(17p). In embodiments, the subject comprises a leukemic cell comprising a mutation in the immunoglobulin heavy-chain variable-region (IgV$_H$) gene. In other embodiments, the subject does not comprise a leukemic cell comprising a mutation in the immunoglobulin heavy-chain variable-region (IgV$_H$) gene. In embodiments, the subject has a deletion in the long arm of chromosome 11 (del(11q)). In other embodiments, the subject does not have a del(11q). In embodiments, idelalisib is administered at a dosage of about 100-400 mg (e.g., 100-125, 125-150, 150-175, 175-200, 200-225, 225-250, 250-275, 275-300, 325-350, 350-375, or 375-400 mg), e.g., BID. In embodiments, duvelisib is administered at a dosage of about 15-100 mg (e.g., about 15-25, 25-50, 50-75, or 75-100 mg), e.g., twice a day. In embodiments, rituximab is administered at a dosage of about 350-550 mg/m$^2$ (e.g., 350-375, 375-400, 400-425, 425-450, 450-475, or 475-500 mg/m$^2$), e.g., intravenously.

In one embodiment, the kinase inhibitor is a dual phosphatidylinositol 3-kinase (PI3K) and mTOR inhibitor selected from 2-Amino-8-[trans-4-(2-hydroxyethoxy)cyclohexyl]-6-(6-methoxy-3-pyridinyl)-4-methyl-pyrido[2,3-d]pyrimidin-7(8H)-one (PF-04691502); N-[4-[[4-(Dimethylamino)-1-piperidinyl]carbonyl]phenyl]-N'-[4-(4,6-di-4-morpholinyl-1,3,5-triazin-2-yl)phenyl]urea (PF-05212384, PKI-587); 2-Methyl-2-{4-[3-methyl-2-oxo-8-(quinolin-3-yl)-2,3-dihydro-1H-imidazo[4,5-c]quinolin-1-yl]phenyl}propanenitrile (BEZ-235); apitolisib (GDC-0980, RG7422); 2,4-Difluoro-N-{2-(methyloxy)-5-[4-(4-pyridazinyl)-6-quinolinyl]-3-pyridinyl}benzenesulfonamide (GSK2126458); 8-(6-methoxypyridin-3-yl)-3-methyl-1-(4-(piperazin-1-yl)-3-(trifluoromethyl)phenyl)-1H-imidazo[4,5-c]quinolin-2(3H)-one Maleic acid (NVP-BGT226); 3-[4-(4-Morpholinylpyrido[3',2':4,5]furo[3,2-d]pyrimidin-2-yl]phenol (PI-103); 5-(9-isopropyl-8-methyl-2-morpholino-9H-purin-6-yl)pyrimidin-2-amine (VS-5584, SB2343); and N-[2-[(3,5-Dimethoxyphenyl)amino]quinoxalin-3-yl]-4-[(4-methyl-3-methoxyphenyl)carbonyl]aminophenylsulfonamide (XL765).

In embodiments, a CAR-expressing cell described herein is administered to a subject in combination with an anaplastic lymphoma kinase (ALK) inhibitor. Exemplary ALK kinases include but are not limited to crizotinib (Pfizer), ceritinib (Novartis), alectinib (Chugai), brigatinib (also called AP26113; Ariad), entrectinib (Ignyta), PF-06463922 (Pfizer), TSR-011 (Tesaro) (see, e.g., Clinical Trial Identifier No. NCT02048488), CEP-37440 (Teva), and X-396 (Xcovery). In some embodiments, the subject has a solid cancer, e.g., a solid cancer described herein, e.g., lung cancer.

The chemical name of crizotinib is 3-[(1R)-1-(2,6-dichloro-3-fluorophenyl)ethoxy]-5-(1-piperidin-4-ylpyrazol-4-yl)pyridin-2-amine. The chemical name of ceritinib is 5-Chloro-N$^2$-[2-isopropoxy-5-methyl-4-(4-piperidinyl)phenyl]-N$^4$-[2-(isopropylsulfonyl)phenyl]-2,4-pyrimidinediamine. The chemical name of alectinib is 9-ethyl-6,6-dimethyl-8-(4-morpholinopiperidin-1-yl)-11-oxo-6,11-dihydro-5H-benzo[b]carbazole-3-carbonitrile. The chemical name of brigatinib is 5-Chloro-N$^2$-{4-[4-(dimethylamino)-1-piperidinyl]-2-methoxyphenyl}-N$^4$-[2-(dimethylphosphoryl)phenyl]-2,4-pyrimidinediamine. The chemical name of entrectinib is N-(5-(3,5-difluorobenzyl)-1H-indazol-3-yl)-4-(4-methylpiperazin-1-yl)-2-((tetrahydro-2H-pyran-4-yl)amino)benzamide. The chemical name of PF-06463922 is (10R)-7-Amino-12-fluoro-2,10,16-trimethyl-15-oxo-10,15,16,17-tetrahydro-2H-8,4-(metheno)pyrazolo[4,3-h][2,5,11]-benzoxadiazacyclotetradecine-3-carbonitrile. The chemical structure of CEP-37440 is (S)-2-((5-chloro-2-((6-(4-(2-hydroxyethyl)piperazin-1-yl)-1-methoxy-6,7,8,9-tetrahydro-5H-benzo[7]annulen-2-yl)amino)pyrimidin-4-yl)amino)-N-methylbenzamide. The chemical name of X-396 is (R)-6-amino-5-(1-(2,6-dichloro-3-fluorophenyl)ethoxy)-N-(4-(4-methylpiperazine-1-carbonyl)phenyl)pyridazine-3-carboxamide.

In one embodiment, the kinase inhibitor is an ITK inhibitor selected from ibrutinib; N-(5-(5-(4-Acetylpiperazine-1-carbonyl)-4-methoxy-2-methylphenylthio)thiazol-2-yl)-4-((3,3-dimethylbutan-2-ylamino)methyl)benzamide (BMS-509744); 7-benzyl-1-(3-(piperidin-1-yl)propyl)-2-(4-(pyridin-4-yl)phenyl)-1H-imidazo[4,5-g]quinoxalin-6(5H)-one (CTA056); R)-3-(1-(1-Acryloylpiperidin-3-yl)-4-amino-1H-pyrazolo[3,4-d]pyrimidin-3-yl)-N-(3-methyl-4-(1-methylethyl))benzamide (PF-06465469).

Drugs that inhibit either the calcium dependent phosphatase calcineurin (cyclosporine and FK506) or inhibit the p70S6 kinase that is important for growth factor induced signaling (rapamycin). (Liu et al., Cell 66:807-815, 1991; Henderson et al., Immun. 73:316-321, 1991; Bierer et al., Curr. Opin. Immun. 5:763-773, 1993) can also be used. In a further aspect, the cell compositions of the present invention may be administered to a patient in conjunction with (e.g., before, simultaneously or following) bone marrow transplantation, T cell ablative therapy using chemotherapy agents such as, fludarabine, external-beam radiation therapy (XRT), cyclophosphamide, and/or antibodies such as OKT3 or CAMPATH. In one aspect, the cell compositions of the present invention are administered following B-cell ablative therapy such as agents that react with CD20, e.g., Rituxan. For example, in one embodiment, subjects may undergo standard treatment with high dose chemotherapy followed by peripheral blood stem cell transplantation. In certain embodiments, following the transplant, subjects receive an infusion of the expanded immune cells of the present invention. In an additional embodiment, expanded cells are administered before or following surgery.

In embodiments, a CAR-expressing cell described herein is administered to a subject in combination with an indoleamine 2,3-dioxygenase (IDO) inhibitor. IDO is an enzyme that catalyzes the degradation of the amino acid, L-tryptophan, to kynurenine. Many cancers overexpress IDO, e.g., prostatic, colorectal, pancreatic, cervical, gastric, ovarian, head, and lung cancer. pDCs, macrophages, and dendritic cells (DCs) can express IDO. Without being bound by theory, it is thought that a decrease in L-tryptophan (e.g., catalyzed by IDO) results in an immunosuppressive milieu by inducing T-cell anergy and apoptosis. Thus, without being bound by theory, it is thought that an IDO inhibitor can enhance the efficacy of a CAR-expressing cell described herein, e.g., by decreasing the suppression or death of a CAR-expressing immune cell. In embodiments, the subject has a solid tumor, e.g., a solid tumor described herein, e.g., prostatic, colorectal, pancreatic, cervical, gastric, ovarian, head, or lung cancer. Exemplary inhibitors of IDO include but are not limited to 1-methyl-tryptophan, indoximod (NewLink Genetics) (see, e.g., Clinical Trial Identifier Nos. NCT01191216; NCT01792050), and INCB024360 (Incyte Corp.) (see, e.g., Clinical Trial Identifier Nos. NCT01604889; NCT01685255)

In embodiments, a CAR-expressing cell described herein is administered to a subject in combination with a modulator of myeloid-derived suppressor cells (MDSCs). MDSCs accumulate in the periphery and at the tumor site of many solid tumors. These cells suppress T cell responses, thereby hindering the efficacy of CAR-expressing cell therapy. Without being bound by theory, it is thought that administration of a MDSC modulator enhances the efficacy of a CAR-expressing cell described herein. In an embodiment, the subject has a solid tumor, e.g., a solid tumor described herein, e.g., glioblastoma. Exemplary modulators of MDSCs include but are not limited to MCS110 and BLZ945. MCS110 is a monoclonal antibody (mAb) against macrophage colony-stimulating factor (M-CSF). See, e.g., Clinical Trial Identifier No. NCT00757757. BLZ945 is a small molecule inhibitor of colony stimulating factor 1 receptor (CSF1R). See, e.g., Pyonteck et al. Nat. Med. 19(2013): 1264-72. The structure of BLZ945 is shown below.

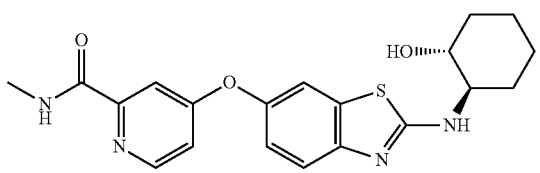 [SMILES: CNC(=O)c1cc(Oc2ccc3nc(N[C@@H]4CCCC[C@H]4O)sc3c2)ccn1]

In embodiments, a CAR-expressing cell described herein is administered to a subject in combination with a CD19 CART cell (e.g., CTL019, e.g., as described in WO2012/079000, incorporated herein by reference). In embodiments, the subject has acute myeloid leukemia (AML), e.g., a CD19 positive AML or a CD19 negative AML. In embodiments, the subject has a CD19+ lymphoma, e.g., a CD19+ Non-Hodgkin's Lymphoma (NHL), a CD19+FL, or a CD19+ DLBCL. In embodiments, the subject has a relapsed or refractory CD19+ lymphoma. In embodiments, a lymphodepleting chemotherapy is administered to the subject prior to, concurrently with, or after administration (e.g., infusion) of CD19 CART cells. In an example, the lymphodepleting chemotherapy is administered to the subject prior to administration of CD19 CART cells. For example, the lymphodepleting chemotherapy ends 1-4 days (e.g., 1, 2, 3, or 4 days) prior to CD19 CART cell infusion. In embodiments, multiple doses of CD19 CART cells are administered, e.g., as described herein. For example, a single dose comprises about $5 \times 10^8$ CD19 CART cells. In embodiments, a lymphodepleting chemotherapy is administered to the subject prior to, concurrently with, or after administration (e.g., infusion) of a CAR-expressing cell described herein, e.g., a non-CD19 CAR-expressing cell. In embodiments, a CD19 CART is administered to the subject prior to, concurrently with, or after administration (e.g., infusion) of a non-CD19 CAR-expressing cell, e.g., a non-CD19 CAR-expressing cell described herein.

In some embodiments, a CAR-expressing cell described herein is administered to a subject in combination with a CD19 CAR-expressing cell, e.g., CTL019, e.g., as described in WO2012/079000, incorporated herein by reference, for treatment of a disease associated with the expression of CLL-1, e.g., a cancer described herein. Without being bound by theory, it is believed that administering a CD19 CAR-expressing cell in combination with a CAR-expressing cell improves the efficacy of a CAR-expressing cell described herein by targeting early lineage cancer cells, e.g., cancer stem cells, modulating the immune response, depleting regulatory B cells, and/or improving the tumor microenvironment. For example, a CD19 CAR-expressing cell targets cancer cells that express early lineage markers, e.g., cancer stem cells and CD19-expressing cells, while the CAR-expressing cell described herein targets cancer cells that express later lineage markers, e.g., CLL-1. This preconditioning approach can improve the efficacy of the CAR-expressing cell described herein. In such embodiments, the CD19 CAR-expressing cell is administered prior to, concurrently with, or after administration (e.g., infusion) of a CAR-expressing cell described herein.

In embodiments, a CAR-expressing cell described herein also expresses a CAR targeting CD19, e.g., a CD19 CAR. In an embodiment, the cell expressing a CAR described herein and a CD19 CAR is administered to a subject for treatment of a cancer described herein, e.g., AML. In an embodiment, the configurations of one or both of the CAR molecules comprise a primary intracellular signaling domain and a costimulatory signaling domain. In another embodiment, the configurations of one or both of the CAR molecules comprise a primary intracellular signaling domain and two or more, e.g., 2, 3, 4, or 5 or more, costimulatory signaling domains. In such embodiments, the CAR molecule described herein and the CD19 CAR may have the same or a different primary intracellular signaling domain, the same or different costimulatory signaling domains, or the same number or a different number of costimulatory signaling domains. Alternatively, the CAR described herein and the CD19 CAR are configured as a split CAR, in which one of the CAR molecules comprises an antigen binding domain and a costimulatory domain (e.g., 4-1BB), while the other CAR molecule comprises an antigen binding domain and a primary intracellular signaling domain (e.g., CD3 zeta).

In some embodiments, a CAR-expressing cell described herein is administered to a subject in combination with a interleukin-15 (IL-15) polypeptide, a interleukin-15 receptor alpha (IL-15Ra) polypeptide, or a combination of both a IL-15 polypeptide and a IL-15Ra polypeptide e.g., hetIL-15 (Admune Therapeutics, LLC). hetIL-15 is a heterodimeric non-covalent complex of IL-15 and IL-15Ra. hetIL-15 is described in, e.g., U.S. Pat. No. 8,124,084, U.S. 2012/0177598, U.S. 2009/0082299, U.S. 2012/0141413, and U.S. 2011/0081311, incorporated herein by reference. In embodiments, het-IL-15 is administered subcutaneously. In embodiments, the subject has a cancer, e.g., solid cancer, e.g., melanoma or colon cancer. In embodiments, the subject has a metastatic cancer.

In embodiments, a subject having a disease described herein, e.g., a hematological disorder, e.g., AML or MDS, is administered a CAR-expressing cell described herein in combination with an agent, e.g., cytotoxic or chemotherapy agent, a biologic therapy (e.g., antibody, e.g., monoclonal antibody, or cellular therapy), or an inhibitor (e.g., kinase inhibitor). In embodiments, the subject is administered a CAR-expressing cell described herein in combination with a cytotoxic agent, e.g., CPX-351 (Celator Pharmaceuticals), cytarabine, daunorubicin, vosaroxin (Sunesis Pharmaceuticals), sapacitabine (Cyclacel Pharmaceuticals), idarubicin, or mitoxantrone. CPX-351 is a liposomal formulation comprising cytarabine and daunorubicin at a 5:1 molar ratio. In embodiments, the subject is administered a CAR-expressing cell described herein in combination with a hypomethylating agent, e.g., a DNA methyltransferase inhibitor, e.g., azacitidine or decitabine. In embodiments, the subject is administered a CAR-expressing cell described herein in combination with a biologic therapy, e.g., an antibody or cellular therapy, e.g., 225Ac-lintuzumab (Actimab-A; Actinium Pharmaceuticals), IPH2102 (Innate Pharma/Bristol Myers Squibb), SGN-CD33A (Seattle Genetics), or gemtuzumab ozogamicin (Mylotarg; Pfizer). SGN-CD33A is an antibody-drug conjugate (ADC) comprising a pyrrolobenzodiazepine dimer that is attached to an anti-CD33 antibody. Actimab-A is an anti-CD33 antibody (lintuzumab) labeled with actinium. IPH2102 is a monoclonal antibody that targets killer immunoglobulin-like receptors (KIRs). In embodiments, the subject is administered a CAR-expressing cell described herein in combination a FLT3 inhibitor, e.g., sorafenib (Bayer), midostaurin (Novartis), quizartinib (Daiichi Sankyo), crenolanib (Arog Pharmaceuticals), PLX3397 (Daiichi Sankyo), AKN-028 (Akinion Pharmaceuticals), or ASP2215 (Astellas). In embodiments, the subject is administered a CAR-expressing cell described herein in combination with an isocitrate dehydrogenase (IDH) inhibitor, e.g., AG-221 (Celgene/Agios) or AG-120 (Agios/Celgene). In embodiments, the subject is administered a CAR-expressing cell described herein in combination with a cell cycle regulator, e.g., inhibitor of polo-like kinase 1 (Plk1), e.g., volasertib (Boehringer Ingelheim); or an inhibitor of cyclin-dependent kinase 9 (Cdk9), e.g., alvocidib (Tolero Pharmaceuticals/Sanofi Aventis). In embodiments, the subject is administered a CAR-expressing cell described herein in combination with a B cell receptor signaling network inhibitor, e.g., an inihibitor of B-cell lymphoma 2 (Bcl-2), e.g., venetoclax (Abbvie/Roche); or an inhibitor of Bruton's tyrosine kinase (Btk), e.g., ibrutinib (Pharmacyclics/Johnson & Johnson Janssen Pharmaceutical). In embodiments, the subject is administered a CAR-expressing cell described herein in combination with an inhibitor of M1 aminopeptidase, e.g., tosedostat (CTI BioPharmaNernalis); an inhibitor of histone deacetylase (HDAC), e.g., pracinostat (MEI Pharma); a multi-kinase inhibitor, e.g., rigosertib (Onconova Therapeutics/Baxter/SymBio); or a peptidic CXCR4 inverse agonist, e.g., BL-8040 (BioLineRx).

In another embodiment, the subjects receive an infusion of the CAR expressing cell, e.g., CD19 CAR-expressing cell, compositions of the present invention prior to transplantation, e.g., allogeneic stem cell transplant, of cells. In a preferred embodiment, CAR expressing cells transiently express the CAR, e.g., by electroporation of an mRNA CAR, whereby the expression of the antigen targeted by the CAR, e.g., CD19 is terminated prior to infusion of donor stem cells to avoid engraftment failure. In one embodiment, the subject can be administered an agent which reduces or ameliorates a side effect associated with the administration of a CAR-expressing cell. Side effects associated with the administration of a CAR-expressing cell include, but are not limited to CRS, and hemophagocytic lymphohistiocytosis (HLH), also termed Macrophage Activation Syndrome (MAS). Symptoms of CRS include high fevers, nausea, transient hypotension, hypoxia, and the like. Accordingly, the methods described herein can comprise administering a CAR-expressing cell described herein to a subject and further administering an agent to manage elevated levels of a soluble factor resulting from treatment with a CAR-expressing cell. In one embodiment, the soluble factor elevated in the subject is one or more of IFN-γ, TNFα, IL-2 and IL-6. Therefore, an agent administered to treat this side effect can be an agent that neutralizes one or more of these soluble factors. Examples of such agents include, but are not limited to a steroid (e.g., corticosteroid), an inhibitor of TNFα, and an inhibitor of IL-6. An example of a TNFα inhibitor is an anti-TNFα antibody molecule such as, infliximab, adalimumab, certolizumab pegol, and golimumab. Another example of a TNFα inhibitor is a fusion protein such as entanercept. Small molecule inhibitor of TNFα include, but are not limited to, xanthine derivatives (e.g. pentoxifylline) and bupropion. An example of an IL-6 inhibitor is an anti-IL-6 antibody molecule such as tocilizumab (toc), sarilumab, elsilimomab, CNTO 328, ALD518/BMS-945429, CNTO 136, CPSI-2364, CDP6038, VX30, ARGX-109, FE301, and FM101. In one embodiment, the anti-IL-6 antibody molecule is tocilizumab. An example of an IL-1R based inhibitor is anakinra.

In embodiments, lymphodepletion is performed on a subject, e.g., prior to administering one or more cells that express a CAR described herein. In embodiments, the lymphodepletion comprises administering one or more of melphalan, cytoxan, cyclophosphamide, and fludarabine.

In embodiments, a lymphodepleting chemotherapy is administered to the subject prior to, concurrently with, or after administration (e.g., infusion) of CAR cells, e.g., cells described herein. In an example, the lymphodepleting chemotherapy is administered to the subject prior to administration of CAR cells. For example, the lymphodepleting chemotherapy ends 1-4 days (e.g., 1, 2, 3, or 4 days) prior to CAR cell infusion. In embodiments, multiple doses of CAR cells are administered, e.g., as described herein. For example, a single dose comprises about $5\times10^8$ CAR cells. In embodiments, a lymphodepleting chemotherapy is administered to the subject prior to, concurrently with, or after administration (e.g., infusion) of a CAR-expressing cell described herein.

In some embodiments, CAR-expressing cells described herein are administered to a subject in combination with a CD19 CAR-expressing cell, e.g., CTL019, e.g., as described in WO2012/079000, incorporated herein by reference, for treatment of a disease associated with the expression of cancer antigen, e.g., a cancer described herein. Without being bound by theory, it is believed that administering a CD19 CAR-expressing cell in combination with another CAR-expressing cell improves the efficacy of a CAR-expressing cell described herein by targeting early lineage cancer cells, e.g., cancer stem cells, modulating the immune response, depleting regulatory B cells, and/or improving the tumor microenvironment. For example, a CD19 CAR-expressing cell targets cancer cells that express early lineage markers, e.g., cancer stem cells and CD19-expressing cells, while some other CAR-expressing cells described herein target cancer cells that express later lineage markers. This preconditioning approach can improve the efficacy of the CAR-expressing cell described herein. In such embodiments, the CD19 CAR-expressing cell is administered prior to, concurrently with, or after administration (e.g., infusion) of the second CAR-expressing cell.

In embodiments, a CAR-expressing cell which expresses a CAR targeting a cancer antigen other than CD19 also expresses a CAR targeting CD19, e.g., a CD19 CAR. In an embodiment, the cell expressing a non-CD19 CAR and a CD19 CAR is administered to a subject for treatment of a cancer described herein, e.g., AML. In an embodiment, the configurations of one or both of the CAR molecules comprise a primary intracellular signaling domain and a costimulatory signaling domain. In another embodiment, the configurations of one or both of the CAR molecules comprise a primary intracellular signaling domain and two or more, e.g., 2, 3, 4, or 5 or more, costimulatory signaling domains. In such embodiments, the non-CD19 CAR molecule and the CD19 CAR may have the same or a different primary intracellular signaling domain, the same or different costimulatory signaling domains, or the same number or a different number of costimulatory signaling domains. Alternatively, the non-CD19 CAR and the CD19 CAR are configured as a split CAR, in which one of the CAR molecules comprises an antigen binding domain and a costimulatory domain (e.g., 4-1BB), while the other CAR molecule comprises an antigen binding domain and a primary intracellular signaling domain (e.g., CD3 zeta).

Inhibitory Molecule Inhibitors/Checkpoint Inhibitors

In one embodiment, the subject can be administered an agent which enhances the activity of a CAR-expressing cell. For example, in one embodiment, the agent can be an agent which inhibits an inhibitory molecule, e.g., the agent is a checkpoint inhibitor. Inhibitory or checkpoint molecules, e.g., Programmed Death 1 (PD1), can, in some embodiments, decrease the ability of a CAR-expressing cell to mount an immune effector response. Examples of inhibitory molecules include PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD160, 2B4, CD80, CD86, B7-H3 (CD276), B7-H4 (VTCN1), HVEM (TNFRSF14 or CD270), KIR, A2aR, MHC class I, MHC class II, GALS, adenosine, and TGFR (e.g., TGFR beta). In embodiments, the CAR-expressing cell described herein comprises a switch costimulatory receptor, e.g., as described in WO 2013/019615, which is incorporated herein by reference in its entirety.

The methods described herein can include administration of a CAR-expressing cell in combination with a checkpoint inhibitor. In one embodiment, the subject is a complete responder. In another embodiment, the subject is a partial responder or non-responder, and, e.g., in some embodiments, the checkpoint inhibitor is administered prior to the CAR-expressing cell, e.g., two weeks, 12 days, 10 days, 8 days, one week, 6 days, 5 days, 4 days, 3 days, 2 days or 1 day before administration of the CAR-expressing cell. In some embodiments, the checkpoint inhibitor is administered concurrently with the CAR-expressing cell.

Inhibition of an inhibitory molecule, e.g., by inhibition at the DNA, RNA or protein level, can optimize a CAR-expressing cell performance. In embodiments, an inhibitory nucleic acid, e.g., an inhibitory nucleic acid, e.g., a dsRNA, e.g., an siRNA or shRNA, or a clustered regularly interspaced short palindromic repeats (CRISPR), a transcription-activator like effector nuclease (TALEN), or a zinc finger endonuclease (ZFN), can be used to inhibit expression of an inhibitory molecule in the CAR-expressing cell. In an embodiment the inhibitor is an shRNA. In an embodiment, the inhibitory molecule is inhibited within a CAR-expressing cell. In these embodiments, a dsRNA molecule that inhibits expression of the inhibitory molecule is linked to the nucleic acid that encodes a component, e.g., all of the components, of the CAR.

In an embodiment, a nucleic acid molecule that encodes a dsRNA molecule that inhibits expression of the molecule that modulates or regulates, e.g., inhibits, T-cell function is operably linked to a promoter, e.g., a H1- or a U6-derived promoter such that the dsRNA molecule that inhibits expression of the molecule that modulates or regulates, e.g., inhibits, T-cell function is expressed, e.g., is expressed within a CAR-expressing cell. See e.g., Tiscornia G., "Development of Lentiviral Vectors Expressing siRNA," Chapter 3, in Gene Transfer: Delivery and Expression of DNA and RNA (eds. Friedmann and Rossi). Cold Spring Harbor Laboratory Press, Cold Spring Harbor, N.Y., USA, 2007; Brummelkamp T R, et al. (2002) Science 296: 550-553; Miyagishi M, et al. (2002) Nat. Biotechnol. 19: 497-500. In an embodiment the nucleic acid molecule that encodes a dsRNA molecule that inhibits expression of the molecule that modulates or regulates, e.g., inhibits, T-cell function is present on the same vector, e.g., a lentiviral vector, that comprises a nucleic acid molecule that encodes a component, e.g., all of the components, of the CAR. In such an embodiment, the nucleic acid molecule that encodes a dsRNA molecule that inhibits expression of the molecule that modulates or regulates, e.g., inhibits, T-cell function is located on the vector, e.g., the lentiviral vector, 5'- or 3'- to the nucleic acid that encodes a component, e.g., all of the components, of the CAR. The nucleic acid molecule that encodes a dsRNA molecule that inhibits expression of the molecule that modulates or regulates, e.g., inhibits, T-cell function can be transcribed in the same or different direction as the nucleic acid that encodes a component, e.g., all of the components, of the CAR. In an embodiment the nucleic acid molecule that encodes a dsRNA molecule that inhibits expression of the molecule that modulates or regulates, e.g., inhibits, T-cell function is present on a vector other than the vector that comprises a nucleic acid molecule that encodes a component, e.g., all of the components, of the CAR. In an embodiment, the nucleic acid molecule that encodes a dsRNA molecule that inhibits expression of the molecule that modulates or regulates, e.g., inhibits, T-cell function it transiently expressed within a CAR-expressing cell. In an embodiment, the nucleic acid molecule that encodes a dsRNA molecule that inhibits expression of the molecule that modulates or regulates, e.g., inhibits, T-cell function is stably integrated into the genome of a CAR-expressing cell. In an embodiment, the molecule that modulates or regulates, e.g., inhibits, T-cell function is PD-1.

In one embodiment, the inhibitor of an inhibitory signal can be, e.g., an antibody or antibody fragment that binds to an inhibitory molecule. For example, the agent can be an antibody or antibody fragment that binds to PD1, PD-L1, PD-L2 or CTLA4 (e.g., ipilimumab (also referred to as MDX-010 and MDX-101, and marketed as Yervoy®; Bristol-Myers Squibb; Tremelimumab (IgG2 monoclonal antibody available from Pfizer, formerly known as ticilimumab, CP-675,206)). In an embodiment, the agent is an antibody or antibody fragment that binds to TIM3. In an embodiment, the agent is an antibody or antibody fragment that binds to LAG3. In an embodiment, the agent is an antibody or antibody fragment that binds to CEACAM (e.g., CEACAM-1, CEACAM-3 and/or CEACAM-5). In embodiments, the agent that enhances the activity of a CAR-expressing cell, e.g., inhibitor of an inhibitory molecule, is administered in combination with an allogeneic CAR, e.g., an allogeneic CAR described herein (e.g., described in the Allogeneic CAR section herein).

PD1 is an inhibitory member of the CD28 family of receptors that also includes CD28, CTLA-4, ICOS, and BTLA. PD1 is expressed on activated B cells, T cells and myeloid cells (Agata et al. 1996 Int. Immunol 8:765-75). Two ligands for PD1, PD-L1 and PD-L2 have been shown to downregulate T cell activation upon binding to PD1 (Freeman et a. 2000 J Exp Med 192:1027-34; Latchman et al. 2001 Nat Immunol 2:261-8; Carter et al. 2002 Eur J Immunol 32:634-43). PD-L1 is abundant in human cancers (Dong et al. 2003 J Mol Med 81:281-7; Blank et al. 2005 Cancer Immunol. Immunother 54:307-314; Konishi et al. 2004 Clin Cancer Res 10:5094). Immune suppression can be reversed by inhibiting the local interaction of PD1 with PD-L1.

Antibodies, antibody fragments, and other inhibitors of PD1, PD-L1 and PD-L2 are available in the art and may be used combination with a CD19 CAR described herein. For example, nivolumab (also referred to as BMS-936558 or MDX1106; Bristol-Myers Squibb) is a fully human IgG4 monoclonal antibody which specifically blocks PD1. Nivolumab (clone 5C4) and other human monoclonal antibodies that specifically bind to PD1 are disclosed in U.S. Pat. No. 8,008,449 and WO2006/121168. Pidilizumab (CT-011; Cure Tech) is a humanized IgG1k monoclonal antibody that binds to PD1. Pidilizumab and other humanized anti-PD1 monoclonal antibodies are disclosed in WO2009/101611. Pembrolizumab (formerly known as lambrolizumab, and also referred to as Keytruda, MK03475; Merck) is a humanized IgG4 monoclonal antibody that binds to PD1. Pembrolizumab and other humanized anti-PD1 antibodies are disclosed in U.S. Pat. No. 8,354,509 and WO2009/114335. MEDI4736 (Medimmune) is a human monoclonal antibody that binds to PDL1, and inhibits interaction of the ligand with PD1. MDPL3280A (Genentech/Roche) is a human Fc optimized IgG1 monoclonal antibody that binds to PD-L1. MDPL3280A and other human monoclonal antibodies to PD-L1 are disclosed in U.S. Pat. No. 7,943,743 and U.S Publication No.: 20120039906. Other anti-PD-L1 binding agents include YW243.55.570 (heavy and light chain variable regions are shown in SEQ ID NOs 20 and 21 in WO2010/077634) and MDX-1 105 (also referred to as BMS-936559, and, e.g., anti-PD-L1 binding agents disclosed in WO2007/005874). AMP-224 (B7-DCIg; Amplimmune; e.g., disclosed in WO2010/027827 and WO2011/066342), is a PD-L2 Fc fusion soluble receptor that blocks the interaction between PD1 and B7-H1. Other anti-PD1 antibodies include AMP 514 (Amplimmune), among others, e.g., anti-PD1 antibodies disclosed in U.S. Pat. No. 8,609,089, US 2010028330, and/or US 20120114649.

In some embodiments, a PD1 inhibitor described herein (e.g., a PD1 antibody, e.g., a PD1 antibody described herein) is used combination with a CD19 CAR described herein to treat a disease associated with expression of CD19. In some embodiments, a PD-L1 inhibitor described herein (e.g., a PD-L1 antibody, e.g., a PD-L1 antibody described herein) is used combination with a CD19 CAR described herein to treat a disease associated with expression of CD19. The disease may be, e.g., a lymphoma such as DLBCL including primary DLBCL or secondary DLBCL. In some embodiments, the subject has, or is identified as having, at least 5%, 6%, 7%, 8%, 9%, 10%, 20%, 30%, 40%, 50%, 60%, 70%, 80%, or 90% of cancer cells, e.g., DLBCL cells, which are CD3+/PD1+. In some embodiments, the subject has, or is identified as having, substantially non-overlapping populations of CD19+ cells and PD-L1+ cells in a cancer, e.g., the cancer microenvironment. For instance, in some embodiments, less than 20%, 10%, 9%, 8%, 7%, 6%, 5%, 4%, 3%, 2%, or 1% of cells in the cancer, e.g., cancer microenvironment, are double positive for CD19 and PD-L1.

In some embodiments, the subject is treated with a combination of a CD19 CAR, a PD1 inhibitor, and a PD-L1 inhibitor. In some embodiments, the subject is treated with a combination of a CD19 CAR, a PD1 inhibitor, and a CD3 inhibitor. In some embodiments, the subject is treated with a combination of a CD19 CAR, a PD1 inhibitor, a PD-L1 inhibitor, and a CD3 inhibitor.

In some embodiments, the methods herein include a step of assaying cells in a biological sample, e.g., a sample comprising DLBCL cells, for CD3 and/or PD-1 (e.g., CD3 and/or PD-1 expression). In some embodiments, the methods include a step of assaying cells in a biological sample, e.g., a sample comprising DLBCL cells, for CD19 and/or PD-L1 (e.g., CD19 and/or PD-L1 expression). In some embodiments, the methods include, e.g., providing a sample comprising cancer cells and performing a detection step, e.g., by immunohistochemistry, for one or more of CD3, PD-1, CD19, or PD-L1. The methods may comprise a further step of recommending or administering a treatment, e.g., a treatment comprising a CD19 CAR.

In one embodiment, the anti-PD-1 antibody or fragment thereof is an anti-PD-1 antibody molecule as described in US 2015/0210769, entitled "Antibody Molecules to PD-1 and Uses Thereof," incorporated by reference in its entirety. In one embodiment, the anti-PD-1 antibody molecule includes at least one, two, three, four, five or six CDRs (or collectively all of the CDRs) from a heavy and light chain variable region from an antibody chosen from any of BAP049-hum01, BAP049-hum02, BAP049-hum03, BAP049-hum04, BAP049-hum05, BAP049-hum06, BAP049-hum07, BAP049-hum08, BAP049-hum09, BAP049-hum10, BAP049-hum11, BAP049-hum12, BAP049-hum13, BAP049-hum14, BAP049-hum15, BAP049-hum16, BAP049-Clone-A, BAP049-Clone-B, BAP049-Clone-C, BAP049-Clone-D, or BAP049-Clone-E; or as described in Table 1 of US 2015/0210769, or encoded by the nucleotide sequence in Table 1, or a sequence substantially identical (e.g., at least 80%, 85%, 90%, 92%, 95%, 97%, 98%, 99% or higher identical) to any of the aforesaid sequences; or closely related CDRs, e.g., CDRs which are identical or which have at least one amino acid alteration, but not more than two, three or four alterations (e.g., substitutions, deletions, or insertions, e.g., conservative substitutions).

In yet another embodiment, the anti-PD-1 antibody molecule comprises at least one, two, three or four variable regions from an antibody described herein, e.g., an antibody chosen from any of BAP049-hum01, BAP049-hum02, BAP049-hum03, BAP049-hum04, BAP049-hum05, BAP049-hum06, BAP049-hum07, BAP049-hum08, BAP049-hum09, BAP049-hum10, BAP049-hum11, BAP049-hum12, BAP049-hum13, BAP049-hum14, BAP049-hum15, BAP049-hum16, BAP049-Clone-A, BAP049-Clone-B, BAP049-Clone-C, BAP049-Clone-D, or BAP049-Clone-E; or as described in Table 1 of US 2015/0210769, or encoded by the nucleotide sequence in Table 1; or a sequence substantially identical (e.g., at least 80%, 85%, 90%, 92%, 95%, 97%, 98%, 99% or higher identical) to any of the aforesaid sequences.

TIM3 (T cell immunoglobulin-3) also negatively regulates T cell function, particularly in IFN-g-secreting CD4+ T helper 1 and CD8+ T cytotoxic 1 cells, and plays a critical role in T cell exhaustion. Inhibition of the interaction between TIM3 and its ligands, e.g., galectin-9 (Gal9), phosphatidylserine (PS), and HMGB1, can increase immune response. Antibodies, antibody fragments, and other inhibitors of TIM3 and its ligands are available in the art and may be used combination with a CD19 CAR described herein. For example, antibodies, antibody fragments, small molecules, or peptide inhibitors that target TIM3 binds to the IgV domain of TIM3 to inhibit interaction with its ligands. Antibodies and peptides that inhibit TIM3 are disclosed in WO2013/006490 and US20100247521. Other anti-TIM3 antibodies include humanized versions of RMT3-23 (disclosed in Ngiow et al., 2011, Cancer Res, 71:3540-3551), and clone 8B.2C12 (disclosed in Monney et al., 2002, Nature, 415:536-541). Bi-specific antibodies that inhibit TIM3 and PD-1 are disclosed in US20130156774.

In one embodiment, the anti-TIM3 antibody or fragment thereof is an anti-TIM3 antibody molecule as described in US 2015/0218274, entitled "Antibody Molecules to TIM3 and Uses Thereof," incorporated by reference in its entirety. In one embodiment, the anti-TIM3 antibody molecule includes at least one, two, three, four, five or six CDRs (or collectively all of the CDRs) from a heavy and light chain variable region from an antibody chosen from any of ABTIM3, ABTIM3-hum01, ABTIM3-hum02, ABTIM3- hum03, ABTIM3-hum04, ABTIM3-hum05, ABTIM3-hum06, ABTIM3-hum07, ABTIM3-hum08, ABTIM3-hum09, ABTIM3-hum10, ABTIM3-hum11, ABTIM3-hum12, ABTIM3-hum13, ABTIM3-hum14, ABTIM3-hum15, ABTIM3-hum16, ABTIM3-hum17, ABTIM3-hum18, ABTIM3-hum19, ABTIM3-hum20, ABTIM3-hum21, ABTIM3-hum22, ABTIM3-hum23; or as described in Tables 1-4 of US 2015/0218274; or encoded by the nucleotide sequence in Tables 1-4; or a sequence substantially identical (e.g., at least 80%, 85%, 90%, 92%, 95%, 97%, 98%, 99% or higher identical) to any of the aforesaid sequences, or closely related CDRs, e.g., CDRs which are identical or which have at least one amino acid alteration, but not more than two, three or four alterations (e.g., substitutions, deletions, or insertions, e.g., conservative substitutions).

In yet another embodiment, the anti-TIM3 antibody molecule comprises at least one, two, three or four variable regions from an antibody described herein, e.g., an antibody chosen from any of ABTIM3, ABTIM3-hum01, ABTIM3-hum02, ABTIM3-hum03, ABTIM3-hum04, ABTIM3-hum05, ABTIM3-hum06, ABTIM3-hum07, ABTIM3-hum08, ABTIM3-hum09, ABTIM3-hum10, ABTIM3-hum11, ABTIM3-hum12, ABTIM3-hum13, ABTIM3-hum14, ABTIM3-hum15, ABTIM3-hum16, ABTIM3-hum17, ABTIM3-hum18, ABTIM3-hum19, ABTIM3-hum20, ABTIM3-hum21, ABTIM3-hum22, ABTIM3-hum23; or as described in Tables 1-4 of US 2015/0218274; or encoded by the nucleotide sequence in Tables 1-4; or a sequence substantially identical (e.g., at least 80%, 85%, 90%, 92%, 95%, 97%, 98%, 99% or higher identical) to any of the aforesaid sequences.

In other embodiments, the agent which enhances the activity of a CAR-expressing cell is a CEACAM inhibitor (e.g., CEACAM-1, CEACAM-3, and/or CEACAM-5 inhibitor). In one embodiment, the inhibitor of CEACAM is an anti-CEACAM antibody molecule. Exemplary anti-CEACAM-1 antibodies are described in WO 2010/125571, WO 2013/082366 WO 2014/059251 and WO 2014/022332, e.g., a monoclonal antibody 34B1, 26H7, and 5F4; or a recombinant form thereof, as described in, e.g., US 2004/0047858, U.S. Pat. No. 7,132,255 and WO 99/052552. In other embodiments, the anti-CEACAM antibody binds to CEACAM-5 as described in, e.g., Zheng et al. PLoS One. 2010 Sep. 2; 5(9). pii: e12529 (DOI:10:1371/journal-.pone.0021146), or crossreacts with CEACAM-1 and CEACAM-5 as described in, e.g., WO 2013/054331 and US 2014/0271618.

Without wishing to be bound by theory, carcinoembryonic antigen cell adhesion molecules (CEACAM), such as CEACAM-1 and CEACAM-5, are believed to mediate, at least in part, inhibition of an anti-tumor immune response (see e.g., Markel et al. J Immunol. 2002 Mar. 15; 168(6): 2803-10; Markel et al. J Immunol. 2006 Nov. 1; 177(9): 6062-71; Markel et al. Immunology. 2009 February; 126(2): 186-200; Markel et al. Cancer Immunol Immunother. 2010 February; 59(2):215-30; Ortenberg et al. Mol Cancer Ther. 2012 June; 11(6):1300-10; Stern et al. J Immunol. 2005 Jun. 1; 174(11):6692-701; Zheng et al. PLoS One. 2010 Sep. 2; 5(9). pii: e12529). For example, CEACAM-1 has been described as a heterophilic ligand for TIM-3 and as playing a role in TIM-3-mediated T cell tolerance and exhaustion (see e.g., WO 2014/022332; Huang, et al. (2014) Nature doi:10.1038/nature13848). In embodiments, co-blockade of CEACAM-1 and TIM-3 has been shown to enhance an anti-tumor immune response in xenograft colorectal cancer models (see e.g., WO 2014/022332; Huang, et al. (2014), supra). In other embodiments, co-blockade of CEACAM-1 and PD-1 reduce T cell tolerance as described, e.g., in WO 2014/059251. Thus, CEACAM inhibitors can be used with the other immunomodulators described herein (e.g., anti-PD-1 and/or anti-TIM-3 inhibitors) to enhance an immune response against a cancer, e.g., a melanoma, a lung cancer (e.g., NSCLC), a bladder cancer, a colon cancer, an ovarian cancer, and other cancers as described herein.

LAG3 (lymphocyte activation gene-3 or CD223) is a cell surface molecule expressed on activated T cells and B cells that has been shown to play a role in CD8+ T cell exhaustion. Antibodies, antibody fragments, and other inhibitors of LAG3 and its ligands are available in the art and may be used combination with a CD19 CAR described herein. For example, BMS-986016 (Bristol-Myers Squib) is a monoclonal antibody that targets LAG3. IMP701 (Immutep) is an antagonist LAG3 antibody and IMP731 (Immutep and GlaxoSmithKline) is a depleting LAG3 antibody. Other LAG3 inhibitors include IMP321 (Immutep), which is a recombinant fusion protein of a soluble portion of LAG3 and Ig that binds to MHC class II molecules and activates antigen presenting cells (APC). Other antibodies are disclosed, e.g., in WO2010/019570.

In one embodiment, the anti-LAG3 antibody or fragment thereof is an anti-LAG3 antibody molecule as described in US 2015/0259420, entitled "Antibody Molecules to LAG3 and Uses Thereof," incorporated by reference in its entirety. In one embodiment, the anti-LAG3 antibody molecule includes at least one, two, three, four, five or six CDRs (or collectively all of the CDRs) from a heavy and light chain variable region from an antibody chosen from any of BAP050-hum01, BAP050-hum02, BAP050-hum03, BAP050-hum04, BAP050-hum05, BAP050-hum06, BAP050-hum07, BAP050-hum08, BAP050-hum09, BAP050-hum10, BAP050-hum11, BAP050-hum12, BAP050-hum13, BAP050-hum14, BAP050-hum15, BAP050-hum16, BAP050-hum17, BAP050-hum18, BAP050-hum19, BAP050-hum20, huBAP050(Ser) (e.g., BAP050-hum01-Ser, BAP050-hum02-Ser, BAP050-hum03-Ser, BAP050-hum04-Ser, BAP050-hum05-Ser, BAP050-hum06-Ser, BAP050-hum07-Ser, BAP050-hum08-Ser, BAP050-hum09-Ser, BAP050-hum10-Ser, BAP050-hum11-Ser, BAP050-hum12-Ser, BAP050-hum13-Ser, BAP050-hum14-Ser, BAP050-hum15-Ser, BAP050-hum18-Ser, BAP050-hum19-Ser, or BAP050-hum20-Ser), BAP050-Clone-F, BAP050-Clone-G, BAP050-Clone-H, BAP050-Clone-I, or BAP050-Clone-J; or as described in Table 1 of US 2015/0259420; or encoded by the nucleotide sequence in Table 1; or a sequence substantially identical (e.g., at least 80%, 85%, 90%, 92%, 95%, 97%, 98%, 99% or higher identical) to any of the aforesaid sequences, or closely related CDRs, e.g., CDRs which are identical or which have at least one amino acid alteration, but not more than two, three or four alterations (e.g., substitutions, deletions, or insertions, e.g., conservative substitutions).

In yet another embodiment, the anti-LAG3 antibody molecule comprises at least one, two, three or four variable regions from an antibody described herein, e.g., an antibody chosen from any of BAP050-hum01, BAP050-hum02, BAP050-hum03, BAP050-hum04, BAP050-hum05, BAP050-hum06, BAP050-hum07, BAP050-hum08, BAP050-hum09, BAP050-hum10, BAP050-hum11, BAP050-hum12, BAP050-hum13, BAP050-hum14, BAP050-hum15, BAP050-hum16, BAP050-hum17, BAP050-hum18, BAP050-hum19, BAP050-hum20, huBAP050(Ser) (e.g., BAP050-hum01-Ser, BAP050- hum02-Ser, BAP050-hum03-Ser, BAP050-hum04-Ser, BAP050-hum05-Ser, BAP050-hum06-Ser, BAP050-hum07-Ser, BAP050-hum08-Ser, BAP050-hum09-Ser, BAP050-hum10-Ser, BAP050-hum11-Ser, BAP050-hum12-Ser, BAP050-hum13-Ser, BAP050-hum14-Ser, BAP050-hum15-Ser, BAP050-hum18-Ser, BAP050-hum19-Ser, or BAP050-hum20-Ser), BAP050-Clone-F, BAP050-Clone-G, BAP050-Clone-H, BAP050-Clone-I, or BAP050-Clone-J; or as described in Table 1 of US 2015/0259420; or encoded by the nucleotide sequence in Tables 1; or a sequence substantially identical (e.g., at least 80%, 85%, 90%, 92%, 95%, 97%, 98%, 99% or higher identical) to any of the aforesaid sequences.

While not wishing to be bound by theory, in some embodiments, a tumor microenvironment is not conducive to CART cells attacking cancer cells, due to direct or indirect inhibitory effects exerted by the presence of PD-L1+ expressing cells or PD1+ T cells within the tumor microenvironment. More specifically, a tumor microenvironment can comprise tumor cells (which are generally CD19+), immune effector cells (which can be CD3+ T cells and can be PD1+ or PD1−, and which can be endogenous cells or CAR-expressing cells), and activated myeloid cells (which are generally PD-L1+). PD1+ T cells can create a "barrier" around the tumor microenvironment by preventing entry of CART cells the tumor. According to the non-limiting theory herein, pre-administration of a PD1 inhibitor and/or PD-L1 inhibitor makes the tumor microenvironment more favorable to entry of CAR-expressing cells into the tumor microenvironment and effectively clear the target positive cancer cells. Data supporting this model is provided herein, e.g., in Examples 20 and 21.

Accordingly, in certain aspects, the present disclosure provides methods of combination therapy comprising administering to a subject a cell that expresses a CAR molecule that binds CD19, e.g., a CD19 CAR, in combination with a PD1 inhibitor, a PD-L1 inhibitor, or both. In some embodiments, the PD1 inhibitor and/or PD-L1 inhibitor is administered before the CAR therapy. In other embodiments, the PD1 inhibitor and/or PD-L1 inhibitor is administered concurrently with or after the CAR therapy. In some aspects, the subject is a subject having a disease associated with expression of CD19, e.g., a hematologic malignancy, e.g., a leukemia or lymphoma, e.g., DLBCL, e.g. primary DLBCL. In some embodiments, the patient has, or is identified as having, elevated levels of PD1, PDL1, or CD3, or any combination thereof. In some embodiments, the patient has, or is identified as having, or at least 5%, 6%, 7%, 8%, 9%, 10%, 20%, 30%, 40%, 50%, 60%, 70%, 80%, or 90% of DLBCL cells which are positive for CD3 and PD1.

Also provided herein are methods for monitoring the efficacy of a CAR therapy, e.g., a CD19 CAR therapy. CAR-expressing cells can be administered to a patient's bloodstream with the intent that the cells home to a tumor cell, e.g., infiltrate a tumor. Accordingly, in some embodiments, the method comprises assaying a tumor sample for the presence of CAR-expressing cells. In embodiments, the method comprises detecting a tumor marker, e.g., CD19. In embodiments, the method comprises detecting a marker of a CAR-expressing cell, e.g., a CAR construct or nucleic acid encoding the CAR construct. In embodiments, the method further comprises detecting a T cell marker, e.g., CD3. In some aspects, the subject is a subject having a disease associated with expression of CD19, e.g., a hematologic malignancy, e.g., a leukemia or lymphoma, e.g., DLBCL, e.g. primary DLBCL. In some embodiments, if the CAR-expressing cells show poor infiltration of the tumor, the subject is identified as at an elevated risk of relapse compared to a subject with good infiltration of the tumor. In some embodiments, if the CAR-expressing cells show poor infiltration of the tumor, the subject is administered a PD1 inhibitor and/or PD-L1 inhibitor, e.g., in combination with a second dose of CAR-expressing cells.

In some embodiments, the agent which enhances the activity of a CAR-expressing cell can be, e.g., a fusion protein comprising a first domain and a second domain, wherein the first domain is an inhibitory molecule, or fragment thereof, and the second domain is a polypeptide that is associated with a positive signal, e.g., a polypeptide comprising an intracellular signaling domain as described herein. In some embodiments, the polypeptide that is associated with a positive signal can include a costimulatory domain of CD28, CD27, ICOS, e.g., an intracellular signaling domain of CD28, CD27 and/or ICOS, and/or a primary signaling domain, e.g., of CD3 zeta, e.g., described herein. In one embodiment, the fusion protein is expressed by the same cell that expressed the CAR. In another embodiment, the fusion protein is expressed by a cell, e.g., a T cell that does not express an anti-CD19 CAR.

In one embodiment, the agent which enhances activity of a CAR-expressing cell described herein is miR-17-92.

In one embodiment, the agent which enhances activity of a CAR-described herein is a cytokine. Cytokines have important functions related to T cell expansion, differentiation, survival, and homeostasis. Cytokines that can be administered to the subject receiving a CAR-expressing cell described herein include: IL-2, IL-4, IL-7, IL-9, IL-15, IL-18, and IL-21, or a combination thereof. In embodiments, the cytokine administered is IL-7, IL-15, or IL-21, or a combination thereof. The cytokine can be administered once a day or more than once a day, e.g., twice a day, three times a day, or four times a day. The cytokine can be administered for more than one day, e.g. the cytokine is administered for 2 days, 3 days, 4 days, 5 days, 6 days, 1 week, 2 weeks, 3 weeks, or 4 weeks. For example, the cytokine is administered once a day for 7 days.

In embodiments, the cytokine is administered in combination with CAR-expressing cells. The cytokine can be administered simultaneously or concurrently with the CAR-expressing cells, e.g., administered on the same day. The cytokine may be prepared in the same pharmaceutical composition as the CAR-expressing cells, or may be prepared in a separate pharmaceutical composition. Alternatively, the cytokine can be administered shortly after administration of the CAR-expressing T cells, e.g., 1 day, 2 days, 3 days, 4 days, 5 days, 6 days, or 7 days after administration of the CAR-expressing cells. In embodiments where the cytokine is administered in a dosing regimen that occurs over more than one day, the first day of the cytokine dosing regimen can be on the same day as administration with the CAR-expressing cells, or the first day of the cytokine dosing regimen can be 1 day, 2 days, 3 days, 4 days, 5 days, 6 days, or 7 days after administration of the CAR-expressing T cells. In one embodiment, on the first day, the CAR-expressing cells are administered to the subject, and on the second day, a cytokine is administered once a day for the next 7 days. In an embodiment, the cytokine to be administered in combination with the CAR-expressing cells is IL-7, IL-15, and/or IL-21.

In other embodiments, the cytokine is administered a sufficient period of time after administration of the CAR-expressing cells, e.g., at least 2 weeks, 3 weeks, 4 weeks, 6 weeks, 8 weeks, 10 weeks, 12 weeks, 4 months, 5 months, 6 months, 7 months, 8 months, 9 months, 10 months, 11 months, or 1 year or more after administration of CAR-expressing cells. In one embodiment, the cytokine is administered after assessment of the subject's response to the CAR-expressing cells. For example, the subject is administered CAR-expressing cells according to the dosage and regimens described herein. The response of the subject to CART therapy is assessed at 2 weeks, 3 weeks, 4 weeks, 6 weeks, 8 weeks, 10 weeks, 12 weeks, 4 months, 5 months, 6 months, 7 months, 8 months, 9 months, 10 months, 11 months, or 1 year or more after administration of CAR-expressing cells, using any of the methods described herein, including inhibition of tumor growth, reduction of circulating tumor cells, or tumor regression. Subjects that do not exhibit a sufficient response to CART therapy can be administered a cytokine. Administration of the cytokine to the subject that has sub-optimal response to the CART therapy improves CART efficacy and/or anti-tumor activity. In an embodiment, the cytokine administered after administration of CAR-expressing cells is IL-7.

Further combination therapies may include anti-allergenic agents, anti-emetics, analgesics, adjunct therapies, Some patients may experience allergic reactions to the therapeutics described herein and/or other anti-cancer agent(s) during or after administration; therefore, anti-allergic agents are often administered to minimize the risk of an allergic reaction. Suitable anti-allergic agents include corticosteroids, such as dexamethasone (e.g., Decadron®), beclomethasone (e.g., Beclovent®), hydrocortisone (also known as cortisone, hydrocortisone sodium succinate, hydrocortisone sodium phosphate, and sold under the tradenames Ala-Cort®, hydrocortisone phosphate, Solu-Cortef®, Hydrocort Acetate® and Lanacort®), prednisolone (sold under the tradenames Delta-Cortel®, Orapred®, Pediapred® and Prelone®), prednisone (sold under the tradenames Deltasone®, Liquid Red®, Meticorten® and Orasone®), methylprednisolone (also known as 6-methylprednisolone, methylprednisolone acetate, methylprednisolone sodium succinate, sold under the tradenames Duralone®, Medralone®, Medrol®, M-Prednisol® and Solu-Medrol®); antihistamines, such as diphenhydramine (e.g., Benadryl®), hydroxyzine, and cyproheptadine; and bronchodilators, such as the beta-adrenergic receptor agonists, albuterol (e.g., Proventil®), and terbutaline (Brethine®).

Some patients may experience nausea during and after administration of the therapeutics described herein and/or other anti-cancer agent(s); therefore, anti-emetics are used in preventing nausea (upper stomach) and vomiting. Suitable anti-emetics include aprepitant (Emend®), ondansetron (Zofran®), granisetron HCl (Kytril®), lorazepam (Ativan®), dexamethasone (Decadron®), prochlorperazine (Compazine®), casopitant (Rezonic® and Zunrisa®), and combinations thereof.

Medication to alleviate the pain experienced during the treatment period is often prescribed to make the patient more comfortable. Common over-the-counter analgesics, such Tylenol®, are often used. However, opioid analgesic drugs such as hydrocodone/paracetamol or hydrocodone/acetaminophen (e.g., Vicodin®), morphine (e.g., Astramorph® or Avinza®), oxycodone (e.g., OxyContin® or Percocet®), oxymorphone hydrochloride (Opana®), and fentanyl (e.g., Duragesic®) are also useful for moderate or severe pain.

In an effort to protect normal cells from treatment toxicity and to limit organ toxicities, cytoprotective agents (such as neuroprotectants, free-radical scavengers, cardioprotectors, anthracycline extravasation neutralizers, nutrients and the like) may be used as an adjunct therapy. Suitable cytoprotective agents include Amifostine (Ethyol®), glutamine, dimesna (Tavocept®), mesna (Mesnex®), dexrazoxane (Zinecard® or Totect®), xaliproden (Xaprila®), and leucovorin (also known as calcium leucovorin, citrovorum factor and folinic acid).

The structure of the active compounds identified by code numbers, generic or trade names may be taken from the actual edition of the standard compendium "The Merck Index" or from databases, e.g. Patents International (e.g. IMS World Publications).

The above-mentioned compounds, which can be used in combination with a compound of the present invention, can be prepared and administered as described in the art, such as in the documents cited above.

In one embodiment, the present invention provides pharmaceutical compositions comprising at least one compound of the present invention (e.g., a compound of the present invention) or a pharmaceutically acceptable salt thereof together with a pharmaceutically acceptable carrier suitable for administration to a human or animal subject, either alone or together with other anti-cancer agents.

In one embodiment, the present invention provides methods of treating human or animal subjects suffering from a cellular proliferative disease, such as cancer. The present invention provides methods of treating a human or animal subject in need of such treatment, comprising administering to the subject a therapeutically effective amount of a compound of the present invention (e.g., a compound of the present invention) or a pharmaceutically acceptable salt thereof, either alone or in combination with other anti-cancer agents.

In particular, compositions will either be formulated together as a combination therapeutic or administered separately.

In combination therapy, the compound of the present invention and other anti-cancer agent(s) may be administered either simultaneously, concurrently or sequentially with no specific time limits, wherein such administration provides therapeutically effective levels of the two compounds in the body of the patient.

In a preferred embodiment, the compound of the present invention and the other anti-cancer agent(s) is generally administered sequentially in any order by infusion or orally. The dosing regimen may vary depending upon the stage of the disease, physical fitness of the patient, safety profiles of the individual drugs, and tolerance of the individual drugs, as well as other criteria well-known to the attending physician and medical practitioner(s) administering the combination. The compound of the present invention and other anti-cancer agent(s) may be administered within minutes of each other, hours, days, or even weeks apart depending upon the particular cycle being used for treatment. In addition, the cycle could include administration of one drug more often than the other during the treatment cycle and at different doses per administration of the drug.

In another aspect of the present invention, kits that include one or more compound of the present invention and a combination partner as disclosed herein are provided. Representative kits include (a) a compound of the present invention or a pharmaceutically acceptable salt thereof, (b) at least one combination partner, e.g., as indicated above, whereby such kit may comprise a package insert or other labeling including directions for administration.

A compound of the present invention may also be used to advantage in combination with known therapeutic processes, for example, the administration of hormones or especially radiation. A compound of the present invention may in particular be used as a radiosensitizer, especially for the treatment of tumors which exhibit poor sensitivity to radiotherapy.

Combination with a Low, Immune-Enhancing Dose of an mTOR Inhibitor

In one embodiment, the cells expressing a CAR molecule, e.g., a CAR molecule described herein, are administered in combination with a low, immune enhancing dose of an mTOR inhibitor. For instance, in an embodiment, the combination therapy includes: CD19 CAR expressing cells, a B-cell inhibitor (inhibitor of one or more of CD10, CD20, CD22, CD34, CD123, FLT-3, or ROR1, e.g., a CAR-expressing cell targeting one or more of CD10, CD20, CD22, CD34, CD123, FLT-3, or ROR1), and an mTOR inhibitor. Methods described herein use low, immune enhancing, doses of mTOR inhibitors, e.g., allosteric mTOR inhibitors, including rapalogs such as RAD001. Administration of a low, immune enhancing, dose of an mTOR inhibitor (e.g., a dose that is insufficient to completely suppress the immune system, but sufficient to improve immune function) can optimize the performance of immune effector cells, e.g., T cells or CAR-expressing cells, in the subject. Methods for measuring mTOR inhibition, dosages, treatment regimens, and suitable pharmaceutical compositions are described in U.S. Patent Application No. 2015/01240036, hereby incorporated by reference.

In an embodiment, administration of a low, immune enhancing, dose of an mTOR inhibitor can result in one or more of the following:
  i) a decrease in the number of PD-1 positive immune effector cells;
  ii) an increase in the number of PD-1 negative immune effector cells;
  iii) an increase in the ratio of PD-1 negative immune effector cells/PD-1 positive immune effector cells;
  iv) an increase in the number of naive T cells;
  v) an increase in the expression of one or more of the following markers: $CD62L^{high}$, $CD127^{high}$, $CD27^+$, and BCL2, e.g., on memory T cells, e.g., memory T cell precursors;
  vi) a decrease in the expression of KLRG1, e.g., on memory T cells, e.g., memory T cell precursors; or
  vii) an increase in the number of memory T cell precursors, e.g., cells with any one or combination of the following characteristics: increased $CD62L^{high}$, increased $CD127^{high}$, increased $CD27^+$, decreased KLRG1, and increased BCL2;
  and wherein any of the foregoing, e.g., i), ii), iii), iv), v), vi), or vii), occurs e.g., at least transiently, e.g., as compared to a non-treated subject.

In another embodiment, administration of a low, immune enhancing, dose of an mTOR inhibitor results in increased or prolonged proliferation or persistence of CAR-expressing cells, e.g., in culture or in a subject, e.g., as compared to non-treated CAR-expressing cells or a non-treated subject. In embodiments, increased proliferation or persistence is associated with in an increase in the number of CAR-expressing cells. Methods for measuring increased or prolonged proliferation are described in Examples 18 and 19. In another embodiment, administration of a low, immune enhancing, dose of an mTOR inhibitor results in increased killing of cancer cells by CAR-expressing cells, e.g., in culture or in a subject, e.g., as compared to non-treated CAR-expressing cells or a non-treated subject. In embodiments, increased killing of cancer cells is associated with in a decrease in tumor volume.

In one embodiment, the cells expressing a CAR molecule, e.g., a CAR molecule described herein, are administered in combination with a low, immune enhancing dose of an mTOR inhibitor, e.g., an allosteric mTOR inhibitor, e.g., RAD001, or a catalytic mTOR inhibitor. For example, administration of the low, immune enhancing, dose of the mTOR inhibitor can be initiated prior to administration of a CAR-expressing cell described herein; completed prior to administration of a CAR-expressing cell described herein; initiated at the same time as administration of a CAR-expressing cell described herein; overlapping with administration of a CAR-expressing cell described herein; or continuing after administration of a CAR-expressing cell described herein.

Alternatively or in addition, administration of a low, immune enhancing, dose of an mTOR inhibitor can optimize immune effector cells to be engineered to express a CAR molecule described herein. In such embodiments, administration of a low, immune enhancing, dose of an mTOR inhibitor, e.g., an allosteric inhibitor, e.g., RAD001, or a catalytic inhibitor, is initiated or completed prior to harvest of immune effector cells, e.g., T cells or NK cells, to be engineered to express a CAR molecule described herein, from a subject.

In another embodiment, immune effector cells, e.g., T cells or NK cells, to be engineered to express a CAR molecule described herein, e.g., after harvest from a subject, or CAR-expressing immune effector cells, e.g., T cells or NK cells, e.g., prior to administration to a subject, can be cultured in the presence of a low, immune enhancing, dose of an mTOR inhibitor.

In an embodiment, administering to the subject a low, immune enhancing, dose of an mTOR inhibitor comprises administering, e.g., once per week, e.g., in an immediate release dosage form, 0.1 to 20, 0.5 to 10, 2.5 to 7.5, 3 to 6, or about 5, mgs of RAD001, or a bioequivalent dose thereof. In an embodiment, administering to the subject a low, immune enhancing, dose of an mTOR inhibitor comprises administering, e.g., once per week, e.g., in a sustained release dosage form, 0.3 to 60, 1.5 to 30, 7.5 to 22.5, 9 to 18, or about 15 mgs of RAD001, or a bioequivalent dose thereof.

In an embodiment, a dose of an mTOR inhibitor is associated with, or provides, mTOR inhibition of at least 5 but no more than 90%, at least 10 but no more than 90%, at least 15, but no more than 90%, at least 20 but no more than 90%, at least 30 but no more than 90%, at least 40 but no more than 90%, at least 50 but no more than 90%, at least 60 but no more than 90%, at least 70 but no more than 90%, at least 5 but no more than 80%, at least 10 but no more than 80%, at least 15, but no more than 80%, at least 20 but no more than 80%, at least 30 but no more than 80%, at least 40 but no more than 80%, at least 50 but no more than 80%, at least 60 but no more than 80%, at least 5 but no more than 70%, at least 10 but no more than 70%, at least 15, but no more than 70%, at least 20 but no more than 70%, at least 30 but no more than 70%, at least 40 but no more than 70%, at least 50 but no more than 70%, at least 5 but no more than 60%, at least 10 but no more than 60%, at least 15, but no more than 60%, at least 20 but no more than 60%, at least 30 but no more than 60%, at least 40 but no more than 60%, at least 5 but no more than 50%, at least 10 but no more than 50%, at least 15, but no more than 50%, at least 20 but no more than 50%, at least 30 but no more than 50%, at least 40 but no more than 50%, at least 5 but no more than 40%, at least 10 but no more than 40%, at least 15, but no more than 40%, at least 20 but no more than 40%, at least 30 but no more than 40%, at least 35 but no more than 40%, at least 5 but no more than 30%, at least 10 but no more than 30%, at least 15, but no more than 30%, at least 20 but no more than 30%, or at least 25 but no more than 30%.

The extent of mTOR inhibition can be conveyed as, or corresponds to, the extent of P70 S6 kinase inhibition, e.g., the extent of mTOR inhibition can be determined by the level of decrease in P70 S6 kinase activity, e.g., by the decrease in phosphorylation of a P70 S6 kinase substrate. The level of mTOR inhibition can be evaluated by various methods, such as measuring P70 S6 kinase activity by the Boulay assay, as described in U.S. Patent Application No. 2015/0124036, hereby incorporated by reference, or as described in U.S. Pat. No. 7,727,950, hereby incorporated by reference; measuring the level of phosphorylated S6 by western blot; or evaluating a change in the ratio of PD1 negative immune effector cells to PD1 positive immune effector cells.

As used herein, the term "mTOR inhibitor" refers to a compound or ligand, or a pharmaceutically acceptable salt thereof, which inhibits the mTOR kinase in a cell. In an embodiment, an mTOR inhibitor is an allosteric inhibitor. Allosteric mTOR inhibitors include the neutral tricyclic compound rapamycin (sirolimus), rapamycin-related compounds, that is compounds having structural and functional similarity to rapamycin including, e.g., rapamycin derivatives, rapamycin analogs (also referred to as rapalogs) and other macrolide compounds that inhibit mTOR activity. In an embodiment, an mTOR inhibitor is a catalytic inhibitor.

Rapamycin is a known macrolide antibiotic produced by *Streptomyces hygroscopicus* having the structure shown in Formula A.

(A)

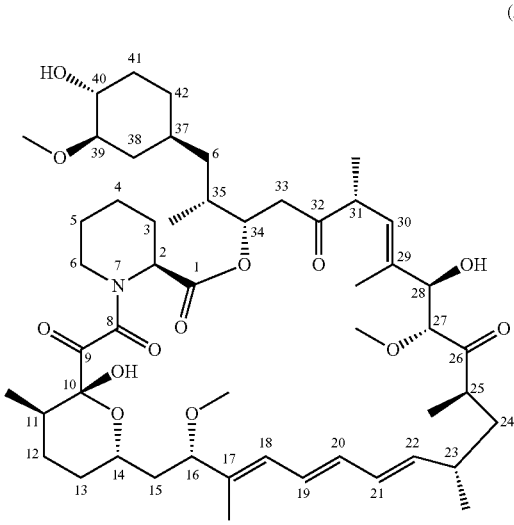

See, e.g., McAlpine, J. B., et al., J. Antibiotics (1991) 44: 688; Schreiber, S. L., et al., J. Am. Chem. Soc. (1991) 113: 7433; U.S. Pat. No. 3,929,992. There are various numbering schemes proposed for rapamycin. To avoid confusion, when specific rapamycin analogs are named herein, the names are given with reference to rapamycin using the numbering scheme of formula A.

Rapamycin analogs useful in the invention are, for example, O-substituted analogs in which the hydroxyl group on the cyclohexyl ring of rapamycin is replaced by $OR_1$ in which $R_1$ is hydroxyalkyl, hydroxyalkoxyalkyl, acylaminoalkyl, or aminoalkyl; e.g. RAD001, also known as everolimus, as described in U.S. Pat. No. 5,665,772 and WO94/09010, the contents of each are incorporated by reference.

Other suitable rapamycin analogs include those substituted at the 26- or 28-position. The rapamycin analog may be an epimer of an analog mentioned above, particularly an epimer of an analog substituted in position 40, 28 or 26, and may optionally be further hydrogenated, e.g. as described in U.S. Pat. No. 6,015,815, WO95/14023 and WO99/15530 the contents of which are incorporated by reference, e.g. ABT578 also known as zotarolimus or a rapamycin analog described in U.S. Pat. No. 7,091,213, WO98/02441 and WO01/14387 the contents of which are incorporated by reference, e.g. AP23573 also known as ridaforolimus.

Examples of rapamycin analogs suitable for use in the present invention from U.S. Pat. No. 5,665,772 include, but are not limited to, 40-O-benzyl-rapamycin, 40-O-(4'-hydroxymethyl)benzyl-rapamycin, 40-O-[4'-(1,2-dihydroxyethyl)]benzyl-rapamycin, 40-O-allyl-rapamycin, 40-O-[3'-(2,2-dimethyl-1,3-dioxolan-4(S)-yl)-prop-2'-en-1'-yl]-rapamycin, (2'E,4'S)-40-O-(4',5'-dihydroxypent-2'-en-1'-yl)-rapamycin, 40-O-(2-hydroxy)ethoxycarbonylmethyl-rapamycin, 40-O-(2-hydroxy)ethyl-rapamycin, 40-O-(3-hydroxy)propyl-rapamycin, 40-O-(6-hydroxy)hexyl-rapamycin, 40-O-[2-(2-hydroxy)ethoxy]ethyl-rapamycin, 40-O-[(3S)-2,2-dimethyldioxolan-3-yl]methyl-rapamycin, 40-O-[(2S)-2,3-dihydroxyprop-1-yl]-rapamycin, 40-O-(2-acetoxy)ethyl-rapamycin, 40-O-(2-nicotinoyloxy)ethyl-rapamycin, 40-O-[2-(N-morpholino)acetoxy]ethyl-rapamycin, 40-O-(2-N-imidazolylacetoxy)ethyl-rapamycin, 40-O-[2-(N-methyl-N'-piperazinyl)acetoxy]ethyl-rapamycin, 39-O-desmethyl-39,40-O,O-ethylene-rapamycin, (26R)-26-dihydro-40-O-(2-hydroxy)ethyl-rapamycin, 40-O-(2-aminoethyl)-rapamycin, 40-O-(2-acetaminoethyl)-rapamycin, 40-O-(2-nicotinamidoethyl)-rapamycin, 40-O-(2-(N-methyl-imidazo-2'-ylcarbethoxamido)ethyl)-rapamycin, 40-O-(2-ethoxycarbonylaminoethyl)-rapamycin, 40-O-(2-tolylsulfonamidoethyl)-rapamycin and 40-O-[2-(4',5'-dicarboethoxy-1',2',3'-triazol-1'-yl)-ethyl]-rapamycin.

Other rapamycin analogs useful in the present invention are analogs where the hydroxyl group on the cyclohexyl ring of rapamycin and/or the hydroxy group at the 28 position is replaced with an hydroxyester group are known, for example, rapamycin analogs found in U.S. RE44,768, e.g. temsirolimus.

Other rapamycin analogs useful in the preset invention include those wherein the methoxy group at the 16 position is replaced with another substituent, e.g., (optionally hydroxy-substituted) alkynyloxy, benzyl, orthomethoxybenzyl or chlorobenzyl and/or wherein the mexthoxy group at the 39 position is deleted together with the 39 carbon so that the cyclohexyl ring of rapamycin becomes a cyclopentyl ring lacking the 39 position methyoxy group; e.g. as described in WO95/16691 and WO96/41807, the contents of which are incorporated by reference. The analogs can be further modified such that the hydroxy at the 40-position of rapamycin is alkylated and/or the 32-carbonyl is reduced.

Rapamycin analogs from WO95/16691 include, but are not limited to, 16-demthoxy-16-(pent-2-ynyl)oxy-rapamycin, 16-demthoxy-16-(but-2-ynyl)oxy-rapamycin, 16-demthoxy-16-(propargyl)oxy-rapamycin, 16-demethoxy-16-(4-hydroxy-but-2-ynyl)oxy-rapamycin, 16-demethoxy-16-benzyloxy-40-O-(2-hydroxyethyl)-rapamycin, 16-demthoxy-16-benzyloxy-rapamycin, 16-demethoxy-16-ortho-methoxybenzyl-rapamycin, 16-demethoxy-40-O-(2-methoxyethyl)-16-pent-2-ynyl)oxy-rapamycin, 39-demethoxy-40-desoxy-39-formyl-42-nor-rapamycin, 39-demethoxy-40-desoxy-39-hydroxymethyl-42-nor-rapamycin, 39-demethoxy-40-desoxy-39-carboxy-42-nor-rapamycin, 39-demethoxy-40-desoxy-39-(4-methyl-piperazin-1-yl)carbonyl-42-nor-rapamycin, 39-demethoxy-40-desoxy-39-(morpholin-4-yl)carbonyl-42-nor-rapamycin, 39-demethoxy-40-desoxy-39-[N-methyl, N-(2-pyridin-2-yl-ethyl)]carbamoyl-42-nor-rapamycin and 39-demethoxy-40-desoxy-39-(p-toluenesulfonylhydrazonomethyl)-42-nor-rapamycin.

Rapamycin analogs from WO96/41807 include, but are not limited to, 32-deoxo-rapamycin, 16-O-pent-2-ynyl-32-deoxo-rapamycin, 16-O-pent-2-ynyl-32-deoxo-40-O-(2-hydroxy-ethyl)-rapamycin, 16-O-pent-2-ynyl-32-(S)-dihydro-40-O-(2-hydroxyethyl)-rapamycin, 32(S)-dihydro-40-O-(2-methoxy)ethyl-rapamycin and 32(S)-dihydro-40-O-(2-hydroxyethyl)-rapamycin.

Another suitable rapamycin analog is umirolimus as described in US2005/0101624 the contents of which are incorporated by reference.

RAD001, otherwise known as everolimus (Afinitor®), has the chemical name (1R,9S,12S,15R,16E,18R,19R,21R,23S,24E,26E,28E,30S,32S,35R)-1,18-dihydroxy-12-{(1R)-2-[(1S,3R,4R)-4-(2-hydroxyethoxy)-3-methoxycyclohexyl]-1-methylethyl}-19,30-dimethoxy-15,17,21,23,29,35-hexamethyl-11,36-dioxa-4-aza-tricyclo[30.3.1.04,9]hexatriaconta-16,24,26,28-tetraene-2,3,10,14,20-pentaone, as described in U.S. Pat. No. 5,665,772 and WO94/09010, the contents of each are incorporated by reference.

Further examples of allosteric mTOR inhibitors include sirolimus (rapamycin, AY-22989), 40-[3-hydroxy-2-(hydroxymethyl)-2-methylpropanoate]-rapamycin (also called temsirolimus or CCI-779) and ridaforolimus (AP-23573/MK-8669). Other examples of allosteric mTor inhibitors include zotarolimus (ABT578) and umirolimus.

Alternatively or additionally, catalytic, ATP-competitive mTOR inhibitors have been found to target the mTOR kinase domain directly and target both mTORC1 and mTORC2. These are also more effective inhibitors of mTORC1 than such allosteric mTOR inhibitors as rapamycin, because they modulate rapamycin-resistant mTORC1 outputs such as 4EBP1-T37/46 phosphorylation and cap-dependent translation.

Catalytic inhibitors include: BEZ235 or 2-methyl-2-[4-(3-methyl-2-oxo-8-quinolin-3-yl-2,3-dihydro-imidazo[4,5-c]quinolin-1-yl)-phenyl]-propionitrile, or the monotosylate salt form (the synthesis of BEZ235 is described in WO2006/122806); CCG168 (otherwise known as AZD-8055, Chresta, C. M., et al., Cancer Res, 2010, 70(1), 288-298) which has the chemical name {5-[2,4-bis-((S)-3-methylmorpholin-4-yl)-pyrido[2,3d]pyrimidin-7-yl]-2-methoxy-phenyl}-methanol; 3-[2,4-bis[(3S)-3-methylmorpholin-4-yl]pyrido[2,3-d]pyrimidin-7-yl]-N-methylbenzamide (WO09104019); 3-(2-aminobenzo[d]oxazol-5-yl)-1-isopropyl-1H-pyrazolo[3,4-d]pyrimidin-4-amine (WO10051043 and WO2013023184); A N-(3-(N-(3-((3,5-dimethoxyphenyl)amino)quinoxaline-2-yl)sulfamoyl)phenyl)-3-methoxy-4-methylbenzamide (WO07044729 and WO12006552); PKI-587 (Venkatesan, A. M., J. Med. Chem., 2010, 53, 2636-2645) which has the chemical name 1-[4-[4-(dimethylamino)piperidine-1-carbonyl]phenyl]-3-[4-(4,6-dimorpholino-1,3,5-triazin-2-yl)phenyl]urea; GSK-2126458 (ACS Med. Chem. Lett., 2010, 1, 39-43) which has the chemical name 2,4-difluoro-N-{2-methoxy-5-[4-(4-pyridazinyl)-6-quinolinyl]-3-pyridinyl}benzenesulfonamide; 5-(9-isopropyl-8-methyl-2-morpholino-9H-purin-6-yl)pyrimidin-2-amine (WO10114484); and (E)-N-(8-(6-amino-5-(trifluoromethyl)pyridin-3-yl)-1-(6-(2-cyanopropan-2-yl)pyridin-3-yl)-3-methyl-1H-imidazo[4,5-c]quinolin-2(3H)-ylidene)cyanamide (WO12007926).

Further examples of catalytic mTOR inhibitors include 8-(6-methoxy-pyridin-3-yl)-3-methyl-1-(4-piperazin-1-yl-3-trifluoromethyl-phenyl)-1,3-dihydro-imidazo[4,5-c]quinolin-2-one (WO2006/122806) and Ku-0063794 (Garcia-Martinez J M, et al., Biochem J., 2009, 421(1), 29-42. Ku-0063794 is a specific inhibitor of the mammalian target of rapamycin (mTOR).) WYE-354 is another example of a catalytic mTOR inhibitor (Yu K, et al. (2009). Biochemical, Cellular, and In vivo Activity of Novel ATP-Competitive and Selective Inhibitors of the Mammalian Target of Rapamycin. Cancer Res. 69(15): 6232-6240).

mTOR inhibitors useful according to the present invention also include prodrugs, derivatives, pharmaceutically acceptable salts, or analogs thereof of any of the foregoing. mTOR inhibitors, such as RAD001, may be formulated for delivery based on well-established methods in the art based on the particular dosages described herein. In particular, U.S. Pat. No. 6,004,973 (incorporated herein by reference) provides examples of formulations useable with the mTOR inhibitors described herein.

Methods and Biomarkers for Evaluating CAR-Effectiveness or Sample Suitability

The present disclosure provides, among other things, gene signatures that indicate whether a cancer patient treated with a CAR therapy is likely to relapse, or has relapsed. Without wishing to be bound by theory, an experimental basis for this gene signature is set out in Example 12.

In an embodiment, novel transcriptional gene signatures described herein (e.g., in Table 29 in Example 12) are used to enable manufactured product improvements, thereby reducing the likelihood of patient relapse. In an embodiment, gene signatures described herein are used to modify therapeutic application of manufactured product, thereby reducing the likelihood of patient relapse.

In an embodiment, gene signatures described herein (e.g., in Table 29 in Example 12) are identified in a subject prior to treatment with a CAR-expressing cell, e.g., CART treatment (e.g., a CART19 treatment, e.g., CTL019 therapy) that predict relapse to CAR treatment. In an embodiment, gene signatures described herein are identified in an apheresis sample or bone marrow sample. In an embodiment, gene signatures described herein are identified in a manufactured CAR-expressing cell product, e.g., CART product (e.g., a CART19 product, e.g., CTL019) prior to infusion.

This disclosure also provides evidence, for instance in Example 12, that (without wishing to be bound by theory) decreasing the $T_{REG}$ signature in the patient prior to apheresis or during manufacturing of the CART product reduces the risk of patient relapse.

In an embodiment, a patient is pre-treated with one or more therapies that reduce $T_{REG}$ cells prior to collection of cells for CAR product manufacturing, e.g., CART product manufacturing, thereby reducing the risk of patient relapse to CAR-expressing cell treatment (e.g., CTL019 treatment). Methods of decreasing $T_{REG}$ cells include, but are not limited to, cyclophosphamide, anti-GITR antibody, CD25-depletion, and combinations thereof.

In an embodiment, a patient is pre-treated with cyclophosphamide or an anti-GITR antibody prior to collection of cells for CAR-expressing cell product manufacturing, thereby reducing the risk of patient relapse to CAR-expressing cell treatment (e.g., CTL019 treatment).

In an embodiment, the CAR-expressing cell manufacturing process is modified to deplete $T_{REG}$ cells prior to manufacturing of the CAR-expressing cell product (e.g., a CTL019 product). In an embodiment, CD25-depletion is used to deplete $T_{REG}$ cells prior to manufacturing of the CAR-expressing cell product (e.g., a CTL019 product).

In an embodiment, after treating a patient or a CAR-expressing cell product with a treatment that reduces $T_{REG}$ cells, the patient is treated with a combination therapy. The combination therapy may comprise, e.g., a CD19 inhibitor such as a CD19 CAR-expressing cell, and one or more B-cell inhibitors, e.g., B-cell inhibitors as described herein.

In an embodiment, a patient is assayed for the level of $T_{REG}$ cells in a patient sample, e.g., a sample comprising cancer cells and/or a sample representing a tumor microenvironment. In an embodiment, this information is used to determine a course of treatment for the patient. For instance, in an embodiment, if the patient is identified as having elevated levels of $T_{REG}$ cells compared to a control, the therapy comprises administering a treatment other than a CAR-expressing cell. For instance, the therapy may comprise administration of an antibody molecule, administration of a small molecule therapeutic, surgery, or radiation therapy, or any combination thereof. This therapy may target one or more B-cell antigens.

In an embodiment, a relapser is a patient having, or who is identified as having, an increased level of expression (e.g., increase in RNA levels) of one or more of (e.g., 2, 3, 4, or all of) the following genes, compared to non relapsers: MIR199A1, MIR1203, uc021ovp, ITM2C, and HLA-DQB1 and/or a decreased levels of expression (e.g., decrease in RNA levels) of one or more of (e.g., 2, 3, 4, 5, 6, 7, 8, 9, 10, 11, or all of) the following genes, compared to non relapsers: PPIAL4D, TTTY10, TXLNG2P, MIR4650-1, KDM5D, USP9Y, PRKY, RPS4Y2, RPS4Y1, NCRNA00185, SULT1E1, and EIF1AY.

In another aspect, the invention features a method of evaluating or monitoring the effectiveness of a CAR-expressing cell therapy, in a subject (e.g., a subject having a cancer), or the suitability of a sample (e.g., an apheresis sample) for a CAR therapy, e.g., therapy including administration of a low, immune-enhancing dose of an mTOR inhibitor. The method includes acquiring a value of effectiveness to the CAR therapy, or sample suitability, wherein said value is indicative of the effectiveness or suitability of the CAR-expressing cell therapy.

In embodiments, the value of effectiveness to the CAR therapy, or sample suitability, comprises a measure of one, two, three, four, five, six or more (all) of the following:

(i) the level or activity of one, two, three, or more (e.g., all) of resting $T_{EFF}$ cells, resting $T_{REG}$ cells, younger T cells (e.g., younger CD4 or CD8 cells, or gamma/delta T cells), or early memory T cells, or a combination thereof, in a sample (e.g., an apheresis sample or a manufactured CAR-expressing cell product sample);

(ii) the level or activity of one, two, three, or more (e.g., all) of activated $T_{EFF}$ cells, activated $T_{REG}$ cells, older T cells (e.g., older CD4 or CD8 cells), or late memory T cells, or a combination thereof, in a sample (e.g., an apheresis sample or a manufactured CAR-expressing cell product sample);

(iii) the level or activity of an immune cell exhaustion marker, e.g., one, two or more immune checkpoint inhibitors (e.g., PD-1, PD-L1, TIM-3 and/or LAG-3) in a sample (e.g., an apheresis sample or a manufactured CAR-expressing cell product sample). In one embodiment, an immune cell has an exhausted phenotype, e.g., co-expresses at least two exhaustion markers, e.g., co-expresses PD-1 and TIM-3. In other embodiments, an immune cell has an exhausted phenotype, e.g., co-expresses at least two exhaustion markers, e.g., co-expresses PD-1 and LAG-3;

(iv) the level or activity of CD27 and/or CD45RO− (e.g., CD27+CD45RO−) immune effector cells, e.g., in a CD4+ or a CD8+ T cell population, in a sample (e.g., an apheresis sample or a manufactured CAR-expressing cell product sample);

(v) the level or activity of one, two, three, four, five, ten, twelve or more of the biomarkers chosen from CCL20, IL-17a and/or IL-6, PD-1, PD-L1, LAG-3, TIM-3, CD57, CD27, CD122, CD62L, KLRG1;

(vi) a cytokine level or activity (e.g., quality of cytokine repertoire) in a CAR-expressing cell product sample; or (vii) a transduction efficiency of a CAR-expressing cell in a manufactured CAR-expressing cell product sample.

In some embodiments of any of the methods disclosed herein, the CAR-expressing cell therapy comprises a plurality (e.g., a population) of CAR-expressing immune effector cells, e.g., a plurality (e.g., a population) of T cells or NK cells, or a combination thereof. In one embodiment, the CAR-expressing cell therapy includes administration of a low, immune-enhancing dose of an mTOR inhibitor.

In some embodiments of any of the methods disclosed herein, the measure of one or more of (i)-(vii) is obtained from an apheresis sample acquired from the subject. The apheresis sample can be evaluated prior to infusion or re-infusion.

In some embodiments of any of the methods disclosed herein, the measure of one or more of (i)-(vii) is obtained from a manufactured CAR-expressing cell product sample. The manufactured CAR-expressing cell product can be evaluated prior to infusion or re-infusion.

In some embodiments of any of the methods disclosed herein, the subject is evaluated prior to receiving, during, or after receiving, the CAR-expressing cell therapy.

In some embodiments of any of the methods disclosed herein, the measure of one or more of (i)-(vii) evaluates a profile for one or more of gene expression, flow cytometry or protein expression.

In some embodiments of any of the methods disclosed herein, the method further comprises identifying the subject as a responder, a non-responder, a relapser or a non-relapser, based on a measure of one or more of (i)-(vii).

In some embodiments of any of the methods disclosed herein, a responder (e.g., a complete responder) has, or is identified as having, a greater level or activity of one, two, or more (all) of GZMK, PPF1BP2, or naïve T cells as compared to a non-responder.

In some embodiments of any of the methods disclosed herein, a non-responder has, or is identified as having, a greater level or activity of one, two, three, four, five, six, seven, or more (e.g., all) of IL22, IL-2RA, IL-21, IRF8, IL8, CCL17, CCL22, effector T cells, or regulatory T cells, as compared to a responder.

In an embodiment, a relapser is a patient having, or who is identified as having, an increased level of expression of one or more of (e.g., 2, 3, 4, or all of) the following genes, compared to non relapsers: MIR199A1, MIR1203, uc021ovp, ITM2C, and HLA-DQB1 and/or a decreased levels of expression of one or more of (e.g., 2, 3, 4, 5, 6, 7, 8, 9, 10, 11, or all of) the following genes, compared to non relapsers: PPIAL4D, TTTY10, TXLNG2P, MIR4650-1, KDM5D, USP9Y, PRKY, RPS4Y2, RPS4Y1, NCRNA00185, SULT1E1, and EIF1AY.

In some embodiments of any of the methods disclosed herein, a complete responder has, or is identified as having, a greater, e.g., a statistically significant greater, percentage of CD8+ T cells compared to a reference value, e.g., a non-responder percentage of CD8+ T cells.

In some embodiments of any of the methods disclosed herein, a complete responder has, or is identified as having, a greater percentage of CD27+CD45RO− immune effector cells, e.g., in the CD8+ population, compared to a reference value, e.g., a non-responder number of CD27+CD45RO− immune effector cells.

In some embodiments of any of the methods disclosed herein, a complete responder or a partial responder has, or is identified as having, a greater, e.g., a statistically significant greater, percentage of CD4+ T cells compared to a reference value, e.g., a non-responder percentage of CD4+ T cells.

In some embodiments of any of the methods disclosed herein, a complete responder has, or is identified as having, a greater percentage of one, two, three, or more (e.g., all) of resting $T_{EFF}$ cells, resting $T_{REG}$ cells, younger T cells (e.g., younger CD4 or CD8 cells, or gamma/delta T cells), or early memory T cells, or a combination thereof, compared to a reference value, e.g., a non-responder number of resting $T_{EFF}$ cells, resting $T_{REG}$ cells, younger T cells (e.g., younger CD4 or CD8 cells), or early memory T cells.

In some embodiments of any of the methods disclosed herein, a non-responder has, or is identified as having, a greater percentage of one, two, three, or more (e.g., all) of activated $T_{EFF}$ cells, activated $T_{REG}$ cells, older T cells (e.g., older CD4 or CD8 cells), or late memory T cells, or a combination thereof, compared to a reference value, e.g., a responder number of activated $T_{EFF}$ cells, activated $T_{REG}$ cells, older T cells (e.g., older CD4 or CD8 cells), or late memory T cells.

In some embodiments of any of the methods disclosed herein, a non-responder has, or is identified as having, a greater percentage of an immune cell exhaustion marker, e.g., one, two or more immune checkpoint inhibitors (e.g., PD-1, PD-L1, TIM-3 and/or LAG-3). In one embodiment, a non-responder has, or is identified as having, a greater percentage of PD-1, PD-L1, or LAG-3 expressing immune effector cells (e.g., CD4+ T cells and/or CD8+ T cells) (e.g., CAR-expressing CD4+ cells and/or CD8+ T cells) compared to the percentage of PD-1 or LAG-3 expressing immune effector cells from a responder.

In one embodiment, a non-responder has, or is identified as having, a greater percentage of immune cells having an exhausted phenotype, e.g., immune cells that co-express at least two exhaustion markers, e.g., co-expresses PD-1, PD-L1 and/or TIM-3. In other embodiments, a non-responder has, or is identified as having, a greater percentage of immune cells having an exhausted phenotype, e.g., immune cells that co-express at least two exhaustion markers, e.g., co-expresses PD-1 and LAG-3.

In some embodiments of any of the methods disclosed herein, a non-responder has, or is identified as having, a greater percentage of PD-1/PD-L1+/LAG-3+ cells in the CAR-expressing cell population compared to a responder (e.g., a complete responder) to the CAR-expressing cell therapy.

In some embodiments of any of the methods disclosed herein, a partial responder has, or is identified as having, a higher percentages of PD-1/PD-L1+/LAG-3+ cells, than a responder, in the CAR-expressing cell population.

In some embodiments of any of the methods disclosed herein, a non-responder has, or is identified as having, an exhausted phenotype of PD1/PD-L1+ CAR+ and co-expression of LAG3 in the CAR-expressing cell population.

In some embodiments of any of the methods disclosed herein, a non-responder has, or is identified as having, a greater percentage of PD-1/PD-L1+/TIM-3+ cells in the CAR-expressing cell population compared to the responder (e.g., a complete responder).

In some embodiments of any of the methods disclosed herein, a partial responders has, or is identified as having, a higher percentage of PD-1/PD-L1+/TIM-3+ cells, than responders, in the CAR-expressing cell population.

In some embodiments of any of the methods disclosed herein, the presence of CD8+CD27+CD45RO− T cells in an apheresis sample is a positive predictor of the subject response to a CAR-expressing cell therapy.

In some embodiments of any of the methods disclosed herein, a high percentage of PD1+ CAR+ and LAG3+ or TIM3+ T cells in an apheresis sample is a poor prognostic predictor of the subject response to a CAR-expressing cell therapy.

In some embodiments of any of the methods disclosed herein, the responder (e.g., the complete or partial responder) has one, two, three or more (or all) of the following profile:

(i) has a greater number of CD27+ immune effector cells compared to a reference value, e.g., a non-responder number of CD27+ immune effector cells;

(ii) has a greater number of CD8+ T cells compared to a reference value, e.g., a non-responder number of CD8+ T cells;

(iii) has a lower number of immune cells expressing one or more checkpoint inhibitors, e.g., a checkpoint inhibitor chosen from PD-1, PD-L1, LAG-3, TIM-3, or KLRG-1, or a combination, compared to a reference value, e.g., a non-responder number of cells expressing one or more checkpoint inhibitors; or (iv) has a greater number of one, two, three, four or more (all) of resting TEFF cells, resting $T_{REG}$ cells, naïve CD4 cells, unstimulated memory cells or early memory T cells, or a combination thereof, compared to a reference value, e.g., a non-responder number of resting $T_{EFF}$ cells, resting $T_{REG}$ cells, naïve CD4 cells, unstimulated memory cells or early memory T cells.

In some embodiments of any of the methods disclosed herein, the cytokine level or activity of (vi) is chosen from one, two, three, four, five, six, seven, eight, or more (or all) of cytokine CCL20/MIP3a, IL17A, IL6, GM-CSF, IFNγ, IL10, IL13, IL2, IL21, IL4, IL5, IL9 or TNFα, or a combination thereof. The cytokine can be chosen from one, two, three, four or more (all) of IL-17a, CCL20, IL2, IL6, or TNFα. In one embodiment, an increased level or activity of a cytokine is chosen from one or both of IL-17a and CCL20, is indicative of increased responsiveness or decreased relapse.

In some embodiments of any of the methods disclosed herein, a transduction efficiency of 15% or higher in (vii) is indicative of increased responsiveness or decreased relapse.

In some embodiments of any of the methods disclosed herein, a transduction efficiency of less than 15% in (vii) is indicative of decreased responsiveness or increased relapse.

In embodiments, the responder, a non-responder, a relapser or a non-relapser identified by the methods herein can be further evaluated according to clinical criteria. For example, a complete responder has, or is identified as, a subject having a disease, e.g., a cancer, who exhibits a complete response, e.g., a complete remission, to a treatment. A complete response may be identified, e.g., using the NCCN Guidelines® (which are incorporated by reference herein in their entireties), as described herein. A partial responder has, or is identified as, a subject having a disease, e.g., a cancer, who exhibits a partial response, e.g., a partial remission, to a treatment. A partial response may be identified, e.g., using the NCCN Guidelines®, as described herein. A non-responder has, or is identified as, a subject having a disease, e.g., a cancer, who does not exhibit a response to a treatment, e.g., the patient has stable disease or progressive disease. A non-responder may be identified, e.g., using the NCCN Guidelines®, as described herein.

Alternatively, or in combination with the methods disclosed herein, responsive to said value, performing one, two, three, four or more of:

administering e.g., to a responder or a non-relapser, a CAR-expressing cell therapy;

administered an altered dosing of a CAR-expressing cell therapy;

altering the schedule or time course of a CAR-expressing cell therapy;

administering, e.g., to a non-responder or a partial responder, an additional agent in combination with a CAR-expressing cell therapy, e.g., a checkpoint inhibitor, e.g., a checkpoint inhibitor described herein;

administering to a non-responder or partial responder a therapy that increases the number of younger T cells in the subject prior to treatment with a CAR-expressing cell therapy;

modifying a manufacturing process of a CAR-expressing cell therapy, e.g., enriching for younger T cells prior to introducing a nucleic acid encoding a CAR, or increasing the transduction efficiency, e.g., for a subject identified as a non-responder or a partial responder;

administering an alternative therapy, e.g., for a non-responder or partial responder or relapser; or if the subject is, or is identified as, a non-responder or a relapser, decreasing the $T_{REG}$ cell population and/or $T_{REG}$ gene signature, e.g., by one or more of CD25 depletion, administration of cyclophosphamide, anti-GITR antibody, or a combination thereof.

In certain embodiments, the subject is pre-treated with an anti-GITR antibody. In certain embodiment, the subject is treated with an anti-GITR antibody prior to infusion or re-infusion.

In some embodiments of the methods described herein, imaging with FDG-PET/CT (PET/CT) is performed on a subject who has been treated with a CAR therapy. This measurement can predict response to the therapy. For instance, in embodiments, metabolically active tumor volume (MTV) and/or [11F]-2-fluoro-2-deoxy-D-glucose (FDG) uptake are measured. In embodiments, a decrease in MTV is indicative of response, e.g., CR (complete response) or PR (partial response), e.g., a post-treatment MTV value of about 0 is indicative of CR, while an increase in MTV is indicative of PD (progressive disease). In embodiments, a decrease in FDG uptake is indicative of response, e.g., CR or PR, while an increase in FDG uptake is indicative of PD. In embodiments, the imaging is performed after administration of the CAR therapy, e.g., about 1 week, 2 weeks, 3 weeks, 4 weeks, 1 month, 2 months, 3 months, 4 months, 5 months, or 6 months after administration of the CAR therapy. In embodiments, the imaging is performed on a subject who does not have symptoms of CRS (cytokine release syndrome), e.g., a patient who suffered from CRS and whose symptoms resolved prior to imaging. In embodiments, the imaging is performed on a subject who has symptoms of CRS. In embodiments, imaging is performed prior to CAR therapy, and the pre-therapy image is compared to a post-therapy image. In embodiments, the subject has a cancer, e.g., lymphoma, e.g., diffuse large B-cell lymphoma (DLBCL) or follicular lymphoma (FL). In some embodiments, the CAR therapy comprises a CAR19-expressing cell, e.g., CTL019. In some embodiments, the CAR therapy comprises a CAR therapy described herein, e.g., a CAR20-expressing cell, a CAR22-expressing cell, or a CAR19-expressing cell, optionally in combination with a B-cell therapy.

Personalized Medicine (Theranostics)

CD19 Characteristics, e.g. Mutations

Without wishing to be bound by theory, some cancer patients show an initial response to a CD19 inhibitor such as a CD19 CAR-expressing cell, and then relapse. In some embodiments, the relapse is caused (at least in part) by a frameshift and/or premature stop codon in CD19 in the cancer cells, or other change in the expression (including expression levels) of CD19 which reduces the ability of a CD19 CAR-expressing cell to target the cancer cells. Such a mutation can reduce the effectiveness of the CD19 therapy and contribute to the patient's relapse. Accordingly, in some embodiments, it can be beneficial when a CD19 therapy is supplemented or replaced with a therapy directed to a second, different target, e.g., a target expressed in B-cells, e.g., one or more of CD10, CD20, CD22, CD34, CD123, FLT-3, or ROR1. Various exemplary combination therapies of this type are disclosed herein.

This application discloses, among other things, methods for treating a subject having cancer comprising one or more of: (1) determining if a subject has a difference, e.g., statistically significant difference, in a characteristic of CD19 relative to a reference characteristic, and (2) if there is a difference between the determined characteristic and reference characteristic, administering to the subject a therapeutically effective dose of a CAR therapy, e.g., CART, thereby treating the subject. The patient may be, e.g., a patient who has relapsed after treatment with a CD19 inhibitor, e.g., a CD19 CAR expressing cell. The patient may be a patient who has received or is receiving a CD19 CAR therapy and is at risk of relapse. The patient may be a non-responder to a CD19 CAR therapy.

The characteristic can be, e.g., a CD19 sequence, e.g., protein or nucleic acid sequence. The sequence can be determined, e.g., as described in the Examples, by high throughput nucleic acid sequencing, or by mass spectrometry of proteins. As described in the Example herein, a patient may relapse after CD19 CART therapy because of mutations in CD19, e.g., in exon 2 of CD19, e.g., a mutation that causes a frameshift and a premature stop codon in CD19. In embodiments, the insertion or deletion does not cause one or both of a frameshift and a premature stop codon. The mutation may be, e.g., an insertion, a deletion, a substitution, a translocation, or a combination of any of the foregoing. The insertion, deletion, or substitution may involve, e.g., at least 1, 2, 3, 4, 5, 10, 15, 20, 20, or 50 nucleotides. The insertion, deletion, or substitution may involve, e.g., at most 2, 3, 4, 5, 10, 15, 20, 20, 50, or 100 nucleotides. In some cases, a population of cells will comprise more than one mutation. In such cases, the mutations can be in overlapping or non-overlapping sub-populations of cells.

In some cases a patient is identified as having a CD19 characteristic that reduces CD19's ability to engage with a CD19 inhibitor such as a CD19 CAR expressing cell. Such a characteristic may be, e.g., a frameshift mutation, a premature stop codon, an alteration in nucleic acid sequence or an alteration in the structure of the primary mRNA transcript. The characteristic may be, e.g., a departure from normal production of CD19 that occurs earlier than splicing. The characteristic may be, e.g., a characteristic other than exon skipping. Such patients may be treated with an inhibitor of another target, e.g., a B-cell inhibitor, for example a CAR expressing cell directed against another epitope, e.g., an epitope within one or more of CD10, CD20, CD22, CD34, CD123, FLT-3, or ROR1.

In some cases, a patient is identified as having a CD19 characteristic that reduces CD19's ability to engage with a CD19 inhibitor, such as a CD19 CAR expressing cell, but does not reduce or abrogate CD19's ability to engage with a second CD19 inhibitor, such as a CD19 inhibitor that binds to a different region on CD19. Such a characteristic may be, e.g., a mutation that does not cause one or both of a frameshift mutation or a premature stop codon. Such a characteristic may be, e.g., an alteration in nucleic acid sequence or an alteration in the structure of the primary mRNA transcript, a departure from normal production of CD19 that occurs earlier than splicing, or a characteristic other than exon skipping. Such patients may be treated with an inhibitor of CD19, e.g., a B-cell inhibitor directed against an intact region of CD19, e.g., a wild-type portion of CD19. For instance, if a mutation is present in exon 2, the second CD19 inhibitor may bind to an exon other than exon 2, or a part of exon 2 that lacks the mutation. The second CD19 inhibitor may be, e.g., a CD19 inhibitor described herein.

$T_{EFF}$ and $T_{REG}$ Signatures

Methods herein can include steps of determining a $T_{REG}$ signature or determining the levels of $T_{EFF}$ cells or $T_{REG}$ cells, e.g., in a patient or in a population of cells e.g., immune cells. Methods herein can also include steps of reducing the level of $T_{REG}$ cells, or decreasing a $T_{REG}$ signature, in a patient or in a population of cells. In some embodiments, a $T_{EFF}$ is a cell with upregulated expression of one or more (e.g., at least 10, 20, 30, 40, 50, 60, 70, 80, or all) of the following genes: AIM2, ALAS1, B4GALT5, BATF, C3orf26, C4orf43, CCL3, CCL4, CCT3, CCT7, CD40LG, CHAC2, CSF2, CTNNA1, EBNA1BP2, EDARADD, EEF1E1, EIF2B3, EIF2S1, FABP5, FAM40B, FKBP4, FOSL1, GFOD1, GLRX2, HSPD1, HSPE1, IFNG, IL15RA, IL21, IL2RA, IL3, KCNK5, KIAA0020, LARP4, LRP8, LTA, MANF, MIR1182, MIR155, MIR155HG, MTCH2, MYOF, NDUFAF1, NLN, NME1, NME1-NME2, OTUD7B, PAM, PDIA6, PEA15, PFKM, PGAM1, PGAM4, PPIL1, PRDX4, PRSS23, PSMD1, PSMD11, PSMD14, PTRH2, PUS7, RBBP8, RPF2, RPP25, SFXN1, SLC27A2, SLC39A14, SLC43A3, SORD, SPR, SRXN1, STIP1, STT3A, TBX21, TMCC2, TMEM165, TNFRSF9, TXN, TXNDC5, UCK2, VDR, WDR12, YWHAG, and ZDHHC16. In some embodiments, a $T_{REG}$ cell is a cell with upregulated expression of one or more (e.g., at least 10, 20, 30, 40, 50, 60, 70, or all) of the following genes: AIM2, ALAS1, BATF, C5orf32, CCL17, CD40LG, CHAC2, CSF1, CTSL1, EBNA1BP2, EDARADD, EMP1, EPAS1, FABP5, FAM40B, FKBP4, FOSL1, GCLM, GK, GPR56, HMOX1, HSPD1, HSPE1, IKBIP, IL10, IL13, IL15RA, IL1RN, IL2RA, IL3, IL4, IL5, IL9, KCNK5, LTA, MANF, MIR1182, MIR155, MIR155HG, MYOF, NDUFAF1, NLN, NME1, NME1-NME2, PANX2, PDIA6, PGAM4, PPIL1, PPPDE2, PRDX4, PRKAR1B, PSMD1, PSMD11, PUS7, RBBP8, SLC27A2, SLC39A14, SLC43A3, SRXN1, STIP1, STT3A, TBX21, TNFRSF11A, TNFRSF1B, TNFRSF8, TNFRSF9, TXN, UCK2, VDR, VTRNA1-3, WDR12, YWHAG, ZDHHC16, and ZNF282. The upregulated expression may be, e.g., measured 16 hours after stimulation. The upregulated expression may be determined, e.g., by measuring RNA levels for the indicated genes.

Pharmaceutical Compositions and Treatments

Pharmaceutical compositions of the present invention may comprise, in some aspects, a CAR-expressing cell, e.g., a plurality of CAR-expressing cells, as described herein, in combination with one or more pharmaceutically or physiologically acceptable carriers, diluents or excipients. Such compositions may comprise buffers such as neutral buffered saline, phosphate buffered saline and the like; carbohydrates such as glucose, mannose, sucrose or dextrans, mannitol; proteins; polypeptides or amino acids such as glycine; antioxidants; chelating agents such as EDTA or glutathione; adjuvants (e.g., aluminum hydroxide); and preservatives. Compositions of the present invention are in one aspect formulated for intravenous administration.

Pharmaceutical compositions of the present invention may be administered in a manner appropriate to the disease to be treated (or prevented). The quantity and frequency of administration will be determined by such factors as the condition of the patient, and the type and severity of the patient's disease, although appropriate dosages may be determined by clinical trials.

In one embodiment, the pharmaceutical composition is substantially free of, e.g., there are no detectable levels of a contaminant, e.g., selected from the group consisting of endotoxin, *mycoplasma*, replication competent lentivirus (RCL), p24, VSV-G nucleic acid, HIV gag, residual anti-CD3/anti-CD28 coated beads, mouse antibodies, pooled human serum, bovine serum albumin, bovine serum, culture media components, vector packaging cell or plasmid components, a bacterium and a fungus. In one embodiment, the bacterium is at least one selected from the group consisting of *Alcaligenes faecalis, Candida albicans, Escherichia coli, Haemophilus influenza, Neisseria meningitides, Pseudomonas aeruginosa, Staphylococcus aureus, Streptococcus pneumonia,* and *Streptococcus pyogenes* group A.

When "an immunologically effective amount," "an anti-tumor effective amount," "a tumor-inhibiting effective amount," or "therapeutic amount" is indicated, the precise amount of the compositions of the present invention to be administered can be determined by a physician with consideration of individual differences in age, weight, tumor size, extent of infection or metastasis, and condition of the patient (subject). In some embodiments, a pharmaceutical composition comprising the cells, e.g., T cells described herein may be administered at a dosage of $10^4$ to $10^9$ cells/kg body weight, in some instances $10^5$ to $10^6$ cells/kg body weight, including all integer values within those ranges. In some embodiments, the cells, e.g., T cells described herein may be administered at $3 \times 10^4$, $1 \times 10^6$, $3 \times 10^6$, or $1 \times 10^7$ cells/kg body weight. The cell compositions may also be administered multiple times at these dosages. The cells can be administered by using infusion techniques that are commonly known in immunotherapy (see, e.g., Rosenberg et al., New Eng. J. of Med. 319:1676, 1988).

In some embodiments, a dose of CAR cells (e.g., CD10, CD19, CD20, CD22, CD34, CD123, FLT-3, or ROR1 CAR cells) comprises about $1 \times 10^5$, $2 \times 10^5$, $5 \times 10^5$, $1 \times 10^6$, $1.1 \times 10^6$, $2 \times 10^6$, $3.6 \times 10^6$, $5 \times 10^6$, $1 \times 10^7$, $1.8 \times 10^7$, $2 \times 10^7$, $5 \times 10^7$, $1 \times 10^8$, $2 \times 10^8$, or $5 \times 10^8$ cells/kg. In some embodiments, a dose of CAR cells (e.g., CD10, CD19, CD20, CD22, CD34, CD123, FLT-3, or ROR1 CAR cells) comprises at least about $1 \times 10^5$, $2 \times 10^5$, $5 \times 10^5$, $1 \times 10^6$, $1.1 \times 10^6$, $2 \times 10^6$, $3.6 \times 10^6$, $5 \times 10^6$, $1 \times 10^7$, $1.8 \times 10^7$, $2 \times 10^7$, $5 \times 10^7$, $1 \times 10^8$, $2 \times 10^8$, or $5 \times 10^8$ cells/kg. In some embodiments, a dose of CAR cells (e.g., CD10, CD19, CD20, CD22, CD34, CD123, FLT-3, or ROR1 CAR cells) comprises up to about $1 \times 10^5$, $2 \times 10^5$, $5 \times 10^5$, $1 \times 10^6$, $1.1 \times 10^6$, $2 \times 10^6$, $3.6 \times 10^6$, $5 \times 10^6$, $1 \times 10^7$, $1.8 \times $10^7$, $2\times10^7$, $5\times10^7$, $1\times10^8$, $2\times10^8$, or $5\times10^8$ cells/kg. In some embodiments, a dose of CAR cells (e.g., CD10, CD19, CD20, CD22, CD34, CD123, FLT-3, or ROR1 CAR cells) comprises about $1.1\times10^6$-$1.8\times10^7$ cells/kg or about $8\times10^5$-$1.5\times10^6$ cells/kg. In some embodiments, a dose of CAR cells (e.g., CD10, CD19, CD20, CD22, CD34, CD123, FLT-3, or ROR1 CAR cells) comprises about $1\times10^7$, $2\times10^7$, $5\times10^7$, $1\times10^8$, $2\times10^8$, $5\times10^8$, $1\times10^9$, $2\times10^9$, or $5\times10^9$ cells. In some embodiments, a dose of CAR cells (e.g., CD10, CD19, CD20, CD22, CD34, CD123, FLT-3, or ROR1 CAR cells) comprises at least about $1\times10^7$, $2\times10^7$, $5\times10^7$, $1\times10^8$, $2\times10^8$, $5\times10^8$, $1\times10^9$, $2\times10^9$, or $5\times10^9$ cells. In some embodiments, a dose of CAR cells (e.g., CD10, CD19, CD20, CD22, CD34, CD123, FLT-3, or ROR1 CAR cells) comprises up to about $1\times10^7$, $2\times10^7$, $5\times10^7$, $1\times10^8$, $2\times10^8$, $5\times10^8$, $1\times10^9$, $2\times10^9$, or $5\times10^9$ cells.

In certain aspects, it may be desired to administer activated cells, e.g., T cells or NK cells, to a subject and then subsequently redraw blood (or have an apheresis performed), activate the cells therefrom according to the present invention, and reinfuse the patient with these activated and expanded cells. This process can be carried out multiple times every few weeks. In certain aspects, cells, e.g., T cells or NK cells, can be activated from blood draws of from 10 cc to 400 cc. In certain aspects, cells, e.g., T cells or NK cells, are activated from blood draws of 20 cc, 30 cc, 40 cc, 50 cc, 60 cc, 70 cc, 80 cc, 90 cc, or 100 cc.

The administration of the subject compositions may be carried out in any convenient manner, including by aerosol inhalation, injection, ingestion, transfusion, implantation or transplantation. The compositions described herein may be administered to a patient trans arterially, subcutaneously, intradermally, intratumorally, intranodally, intramedullary, intramuscularly, by intravenous (i.v.) injection, or intraperitoneally. In one aspect, the cell compositions, e.g., T cell or NK cell compositions, of the present invention are administered to a patient by intradermal or subcutaneous injection. In one aspect, the cell compositions e.g., T cell or NK cell compositions, of the present invention are administered by i.v. injection. The compositions of cells e.g., T cell or NK cell compositions, may be injected directly into a tumor, lymph node, or site of infection.

In a particular exemplary aspect, subjects may undergo leukapheresis, wherein leukocytes are collected, enriched, or depleted ex vivo to select and/or isolate the cells of interest, e.g., T cells. These cell isolates, e.g., T cell or NK cell isolates, may be expanded by methods known in the art and treated such that one or more CAR constructs of the invention may be introduced, thereby creating a CAR-expressing cell, e.g., CAR T cell of the invention. Subjects in need thereof may subsequently undergo standard treatment with high dose chemotherapy followed by peripheral blood stem cell transplantation. In certain aspects, following or concurrent with the transplant, subjects receive an infusion of the expanded CAR-expressing cells of the present invention. In an additional aspect, expanded cells are administered before or following surgery.

The dosage of the above treatments to be administered to a patient will vary with the precise nature of the condition being treated and the recipient of the treatment. The scaling of dosages for human administration can be performed according to art-accepted practices. The dose for a therapeutic, e.g., an antibody, e.g., CAMPATH, for example, may be, e.g., in the range 1 to about 100 mg for an adult patient, e.g., administered daily for a period between 1 and 30 days. A suitable daily dose is 1 to 10 mg per day although in some instances larger doses of up to 40 mg per day may be used (described in U.S. Pat. No. 6,120,766).

In one embodiment, the CAR is introduced into cells, e.g., T cells or NK cells, e.g., using in vitro transcription, and the subject (e.g., human) receives an initial administration of CAR-expressing cells, e.g., CAR T cells of the invention, and one or more subsequent administrations of the CAR-expressing cells, e.g., CAR T cells of the invention, wherein the one or more subsequent administrations are administered less than 15 days, e.g., 14, 13, 12, 11, 10, 9, 8, 7, 6, 5, 4, 3, or 2 days after the previous administration. In one embodiment, more than one administration of the CAR-expressing cells, e.g., CAR T cells of the invention are administered to the subject (e.g., human) per week, e.g., 2, 3, or 4 administrations of the CAR-expressing cells, e.g., CAR T cells of the invention are administered per week. In one embodiment, the subject (e.g., human subject) receives more than one administration of the CAR-expressing cells, e.g., CAR T cells per week (e.g., 2, 3 or 4 administrations per week) (also referred to herein as a cycle), followed by a week of no CAR-expressing cells, e.g., CAR T cells administrations, and then one or more additional administration of the CAR-expressing cells, e.g., CAR T cells (e.g., more than one administration of the CAR-expressing cells, e.g., CAR T cells per week) is administered to the subject. In another embodiment, the subject (e.g., human subject) receives more than one cycle of CAR-expressing cells, e.g., CAR T cells, and the time between each cycle is less than 10, 9, 8, 7, 6, 5, 4, or 3 days. In one embodiment, the CAR-expressing cells, e.g., CAR T cells are administered every other day for 3 administrations per week. In one embodiment, the CAR-expressing cells, e.g., CAR T cells of the invention are administered for at least two, three, four, five, six, seven, eight or more weeks.

In some embodiments, subjects may be adult subjects (i.e., 18 years of age and older). In certain embodiments, subjects may be between 1 and 30 years of age. In some embodiments, the subjects are 16 years of age or older. In certain embodiments, the subjects are between 16 and 30 years of age. In some embodiments, the subjects are child subjects (i.e., between 1 and 18 years of age).

In one aspect, CAR-expressing cells, e.g., CARTs are generated using lentiviral viral vectors, such as lentivirus. CAR-expressing cells, e.g., CARTs generated that way will have stable CAR expression.

In one aspect, CAR-expressing cells, e.g., CARTs, are generated using a viral vector such as a gammaretroviral vector, e.g., a gammaretroviral vector described herein. CARTs generated using these vectors can have stable CAR expression.

In one aspect, CAR-expressing cells, e.g., CARTs transiently express CAR vectors for 4, 5, 6, 7, 8, 9, 10, 11, 12, 13, 14, 15 days after transduction. Transient expression of CARs can be effected by RNA CAR vector delivery. In one aspect, the CAR RNA is transduced into the cell, e.g., NK cell or T cell, by electroporation.

A potential issue that can arise in patients being treated using transiently expressing CAR T cells (particularly with murine scFv bearing CARTs) is anaphylaxis after multiple treatments.

Without being bound by this theory, it is believed that such an anaphylactic response might be caused by a patient developing humoral anti-CAR response, i.e., anti-CAR antibodies having an anti-IgE isotype. It is thought that a patient's antibody producing cells undergo a class switch from IgG isotype (that does not cause anaphylaxis) to IgE isotype when there is a ten to fourteen day break in exposure to antigen.

If a patient is at high risk of generating an anti-CAR antibody response during the course of transient CAR therapy (such as those generated by RNA transductions), CART infusion breaks should not last more than ten to fourteen days.

CD19 Antibodies and CARs

Humanization of Murine Anti-CD19 Antibody

Humanization of murine CD19 antibody is desired for the clinical setting, where the mouse-specific residues may induce a human-anti-mouse antigen (HAMA) response in patients who receive CART19 treatment, i.e., treatment with T cells transduced with the CAR19 construct. The production, characterization, and efficacy of humanized CD19 CAR sequences is described in International Application WO2014/153270 which is herein incorporated by reference in its entirety, including Examples 1-5 (p. 115-159), for instance Tables 3, 4, and 5 (p. 125-147).

CAR Constructs, e.g., CD19 CAR Constructs

Of the CD19 CAR constructs described in International Application WO2014/153270, certain sequences are reproduced herein. It is understood that the sequences in this section can also be used in the context of other CARs, e.g., CD10 CARs, CD20 CARs, CD22 CARs, CD34 CARs, CD123 CARs, FLT-3 CARs, ROR1 CARs, CD79b CARs, CD179b CARs, or CD79a CARs.

The sequences of the humanized scFv fragments (SEQ ID NOS: 1-12) are provided below in Table 2. Full CAR constructs were generated using SEQ ID NOs: 1-12 with additional sequences, SEQ ID NOs: 13-17, shown below, to generate full CAR constructs with SEQ ID NOs: 31-42.

```
leader (amino acid sequence)
                                    (SEQ ID NO: 13)
MALPVTALLLPLALLLHAARP leader (nucleic acid sequence)
                                    (SEQ ID NO: 54)
ATGGCCCTGCCTGTGACAGCCCTGCTGCTGCCTCTGGCTCTGCTGCTGCA

TGCCGCTAGACCC

CD8 hinge (amino acid sequence)
                                    (SEQ ID NO: 14)
TTTPAPRPPTPAPTIASQPLSLRPEACRPAAGGAVHTRGLDFACD CD8 hinge (nucleic acid sequence)
                                    (SEQ ID NO: 55)
ACCACGACGCCAGCGCCGCGACCACCAACACCGGCGCCCACCATCGCGTC

GCAGCCCCTGTCCCTGCGCCCAGAGGCGTGCCGGCCAGCGGCGGGGGGCG

CAGTGCACACGAGGGGGCTGGACTTCGCCTGTGAT

CD8 transmembrane (amino acid sequence)
                                    (SEQ ID NO: 15)
IYIWAPLAGTCGVLLLSLVITLYC transmembrane (nucleic acid sequence)
                                    (SEQ ID NO: 56)
ATCTACATCTGGGCGCCCTTGGCCGGGACTTGTGGGGTCCTTCTCCTGTC

ACTGGTTATCACCCTTTACTGC 4-1BB Intracellular domain (amino acid sequence)
                                    (SEQ ID NO: 16)
KRGRKKLLYIFKQPFMRPVQTTQEEDGCSCRFPEEEEGGCEL 4-1BB Intracellular domain (nucleic acid sequence)
                                    (SEQ ID NO: 60)
AAACGGGGCAGAAAGAAACTCCTGTATATATTCAAACAACCATTTATGAG

ACCAGTACAAACTACTCAAGAGGAAGATGGCTGTAGCTGCCGATTTCCAG

AAGAAGAAGAAGGAGGATGTGAACTG

CD3 zeta domain (amino acid sequence)
                                    (SEQ ID NO: 17)
RVKFSRSADAPAYKQGQNQLYNELNLGRREEYDVLDKRRGRDPEMGGKPR

RKNPQEGLYNELQKDKMAEAYSEIGMKGERRRGKGHDGLYQGLSTATKDT

YDALHMQALPPR

CD3 zeta (nucleic acid sequence)
                                    (SEQ ID NO: 101)
AGAGTGAAGTTCAGCAGGAGCGCAGACGCCCCCGCGTACAAGCAGGGCCA

GAACCAGCTCTATAACGAGCTCAATCTAGGACGAAGAGAGGAGTACGATG

TTTTGGACAAGAGACGTGGCCGGGACCCTGAGATGGGGGGAAAGCCGAGA

AGGAAGAACCCTCAGGAAGGCCTGTACAATGAACTGCAGAAAGATAAGAT

GGCGGAGGCCTACAGTGAGATTGGGATGAAAGGCGAGCGCCGGAGGGGCA

AGGGGCACGATGGCCTTTACCAGGGTCTCAGTACAGCCACCAAGGACACC

TACGACGCCCTTCACATGCAGGCCCTGCCCCCTCGC

CD3 zeta domain (amino acid sequence;
NCBI Reference Sequence NM_000734.3)
                                    (SEQ ID NO: 43)
RVKFSRSADAPAYQQGQNQLYNELNLGRREEYDVLDKRRGRDPEMGGKPR

RKNPQEGLYNELQKDKMAEAYSEIGMKGERRRGKGHDGLYQGLSTATKDT

YDALHMQALPPR

CD3 zeta (nucleic acid sequence; NCBI
Reference Sequence NM_000734.3);
                                    (SEQ ID NO: 44)
AGAGTGAAGTTCAGCAGGAGCGCAGACGCCCCCGCGTACCAGCAGGGCCA

GAACCAGCTCTATAACGAGCTCAATCTAGGACGAAGAGAGGAGTACGATG

TTTTGGACAAGAGACGTGGCCGGGACCCTGAGATGGGGGGAAAGCCGAGA

AGGAAGAACCCTCAGGAAGGCCTGTACAATGAACTGCAGAAAGATAAGAT

GGCGGAGGCCTACAGTGAGATTGGGATGAAAGGCGAGCGCCGGAGGGGCA

AGGGGCACGATGGCCTTTACCAGGGTCTCAGTACAGCCACCAAGGACACC

TACGACGCCCTTCACATGCAGGCCCTGCCCCCTCGC

CD28 domain
            (amino acid sequence, SEQ ID NO: 1317)
RSKRSRLLHSDYMNMTPRRPGPTRKHYQPYAPPRDFAAYRS CD28 domain
            (nucleotide sequence, SEQ ID NO: 1318)
AGGAGTAAGAGGAGCAGGCTCCTGCACAGTGACTACATGAACATGACTCC

CCGCCGCCCCGGGCCCACCCGCAAGCATTACCAGCCCTATGCCCCACCAC

GCGACTTCGCAGCCTATCGCTCC

Wild-type ICOS domain
            (amino acid sequence, SEQ ID NO: 1319)
TKKKYSSSVHDPNGEYMFMRAVNTAKKSRLTDVTL
```

Wild-type ICOS domain
        (nucleotide sequence, SEQ ID NO: 1320)
ACAAAAAAGAAGTATTCATCCAGTGTGCACGACCCTAACGGTGAATACAT

GTTCATGAGAGCAGTGAACACAGCCAAAAAATCCAGACTCACAGATGTGA

CCCTA

Y to F mutant ICOS domain
        (amino acid sequence, SEQ ID NO: 1321)
TKKKYSSSVHDPNGEFMFMRAVNTAKKSRLTDVTL IgG4 Hinge (amino acid sequence)
        (SEQ ID NO: 102)
ESKYGPPCPPCPAPEFLGGPSVFLFPPKPKDTLMISRTPEVTCVVVDVSQ

EDPEVQFNWYVDGVEVHNAKTKPREEQFNSTYRVVSVLTVLHQDWLNGKE

YKCKVSNKGLPSSIEKTISKAKGQPREPQVYTLPPSQEEMTKNQVSLTCL

VKGFYPSDIAVEWESNGQPENNYKTTPPVLDSDGSFFLYSRLTVDKSRWQ

EGNVFSCSVMHEALHNHYTQKSLSLSLGKM

IgG4 Hinge (nucleotide sequence)
        (SEQ ID NO: 103)
GAGAGCAAGTACGGCCCTCCCTGCCCCCCTTGCCCTGCCCCCGAGTTCCT

GGGCGGACCCAGCGTGTTCCTGTTCCCCCCCAAGCCCAAGGACACCCTGA

TGATCAGCCGGACCCCCGAGGTGACCTGTGTGGTGGTGGACGTGTCCCAG

GAGGACCCCGAGGTCCAGTTCAACTGGTACGTGGACGGCGTGGAGGTGCA

CAACGCCAAGACCAAGCCCCGGGAGGAGCAGTTCAATAGCACCTACCGGG

TGGTGTCCGTGCTGACCGTGCTGCACCAGGACTGGCTGAACGGCAAGGAA

TACAAGTGTAAGGTGTCCAACAAGGGCCTGCCCAGCAGCATCGAGAAAAC

CATCAGCAAGGCCAAGGGCCAGCCTCGGGAGCCCCAGGTGTACACCCTGC

CCCCTAGCCAAGAGGAGATGACCAAGAACCAGGTGTCCCTGACCTGCCTG

GTGAAGGGCTTCTACCCCAGCGACATCGCCGTGGAGTGGGAGAGCAACGG

CCAGCCCGAGAACAACTACAAGACCACCCCCCCTGTGCTGGACAGCGACG

GCAGCTTCTTCCTGTACAGCCGGCTGACCGTGGACAAGAGCCGGTGGCAG

GAGGGCAACGTCTTTAGCTGCTCCGTGATGCACGAGGCCCTGCACAACCA

CTACACCCAGAAGAGCCTGAGCCTGTCCCTGGGCAAGATG

These clones all contained a Q/K residue change in the signal domain of the co-stimulatory domain derived from 4-1BB.

TABLE 2

Humanized CD19 CAR Constructs

| Name | SEQ ID | Sequence |
|---|---|---|
| CAR 1 | | |
| CAR1 scFv domain | 1 | EIVMTQSPATLSLSPGERATLSCRASQDISKYLNWYQQKPGQAPRLLIYHT SRLHSGIPARFSGSGSGTDYTLTISSLQPEDFAVYFCQQGNTLPYTFGQGT KLEIKGGGGSGGGGSGGGGSQVQLQESGPGLVKPSETLSLTCTVSGVSLPD YGVSWIRQPPGKGLEWIGVIWGSETTYYSSSLKSRVTISKDNSKNQVSLKL SSVTAADTAVYYCAKHYYYGGSYAMDYWGQGTLVTVSS |
| 103101 CAR1 Soluble scFv - nt | 61 | atggcctccctgtcaccgccctgctgcttccgctggctcttctgctccacgccgc tcggcccgaaattgtgatgacccagtcacccgccactcttagcctttcacccggtg agcgcgcaacctgtcttgcagagcctcccaagacatctcaaaataccttaattgg tatcaacagaagcccggacaggctcctcgccttctgatctaccacaccagccggct ccattctggaatccctgccaggttcagcggtagcggatctgggaccgactacaccc tcactatcagctcactgcagccagaggacttcgctgtctatttctgtcagcaaggg aacaccctgccctacacctttggacagggcaccaagctcgagattaaaggtggagg tggcagcggaggaggtgggtccggcggtggaggaagccaggtccaactccaagaaa gcggacccgggtcttgtgaagccatcagaaactctttcactgacttgtactgtgagc ggagtgtctctccccgattacggggtgtcttggatcagacagccaccggggaaggg tctggaatggattggagtgattgggggctctgagactacttactactcttcatccc tcaagtcacgcgtcaccatctcaaaggacaactctaagaatcaggtgtcactgaaa ctgtcatctgtgaccgcagccgacaccgccgtgtactattgcgctaagcattacta ttatggcgggagctacgcaatggattactggggacagggtactctggtcaccgtgt ccagccaccaccatcatccaccatccat |
| 103101 CAR1 Soluble scFv - aa | 73 | MALPVTALLLPLALLLHAARPeivmtqspatlslspgeratlscrasqdiskylnw yqqkpgqaprlliyhtsrlhsgiparfsgsgsgtdytltisslqpedfavyfcqqg ntlpytfgqgtkleikggggsggggsggggsqvqlqesgpglvkpsetlsltctvs gvslpdygvswirqppgkglewigviwgsettyyssslksrvtiskdnsknqvslk lssvtaadtavyycakhyyyggsyamdywgqgtlvtvsshhhhhhhh |
| 104875 CAR 1 - Full - nt | 85 | atggcctccctgtcaccgccctgctgcttccgctggctcttctgctccacgccgc tcggcccgaaattgtgatgacccagtcacccgccactcttagcctttcacccggtg agcgcgcaacctgtcttgcagagcctcccaagacatctcaaaataccttaattgg tatcaacagaagcccggacaggctcctcgccttctgatctaccacaccagccggct ccattctggaatccctgccaggttcagcggtagcggatctgggaccgactacaccc tcactatcagctcactgcagccagaggacttcgctgtctatttctgtcagcaaggg aacaccctgccctacacctttggacagggcaccaagctcgagattaaaggtggagg tggcagcggaggaggtgggtccggcggtggaggaagccaggtccaactccaagaaa gcggacccgggtcttgtgaagccatcagaaactctttcactgacttgtactgtgagc ggagtgtctctccccgattacggggtgtcttggatcagacagccaccggggaaggg tctggaatggattggagtgattgggggctctgagactacttactactcttcatccc tcaagtcacgcgtcaccatctcaaaggacaactctaagaatcaggtgtcactgaaa |

TABLE 2-continued

Humanized CD19 CAR Constructs

| Name | SEQ ID | Sequence |
|---|---|---|
| | | ctgtcatctgtgaccgcagccgacaccgccgtgtactattgcgctaagcattacta<br>ttatggcgggagctacgcaatggattactggggacagggtactctggtcaccgtgt<br>ccagcaccactaccccagcaccgaggccacccaccccggctcctaccatcgcctcc<br>cagcctctgtccctgcgtccggaggcatgtagacccgcagctggtggggccgtgca<br>tacccggggtcttgacttcgcctgcgatatctacatttgggcccctctggctggta<br>cttgcggggtcctgctgctttcactcgtgatcactctttactgtaagcgcggtcgg<br>aagaagctgctgtacatctttaagcaaccctt catgaggcctgtgcagactactca<br>agaggaggacggctgttcatgccggttcccagaggaggaggaaggcggctgcgaac<br>tgcgcgtgaaattcagccgcagccagatgctccagcctacaagcaggggcagaac<br>cagctctacaacgaactcaatcttggtcggagagaggagtacgacgtgctggacaa<br>gcggagaggacgggacccagaaatgggcggaagccgcgcagaaagaatccccaag<br>agggcctgtacaacgagctccaaaaggataagatggcagaagcctatagcgagatt<br>ggtatgaaaggggaacgcagaagaggcaaaggccacgacggactgtaccagggact<br>cagcaccgccaccaaggacacctatgacgctcttcacatgcaggccctgccgcctc<br>gg |
| 104875<br>CAR 1 -<br>Full - aa | 31 | MALPVTALLLPLALLLHAARPeivmtqspatlslspgeratlscrasqdiskylnw<br>yqqkpgqaprlliyhtsrlhsgiparfsgsgsgtdytltisslqpedfavyfcqqg<br>ntlpytfgqgtkleikggggsggggsggggsqvqlqesgpglvkpsetlsltctvs<br>gvslpdygvswirqppgkglewigviwgsettyyssslksrvtiskdnsknqvslk<br>lssvtaadtavyycakhyyyggsyamdywgqgtlvtvssttpaprpptpaptias<br>qplslrpeacrpaaggavhtrgldfacdiyiwaplagtcgvlllslvitlyckrgr<br>kkllyifkqpfmrpvqtteedgcscrfpeeeeggcelrvkfsrsadapaykqgqn<br>qlynelnlgrreeydvldkrrgrdpemggkprrknpqeglynelqkdkmaeaysei<br>gmkgerrrgkghdglyqglstatkdtydalhmqalppr |

CAR 2

| CAR2 scFv<br>domain | 2 | eivmtqspatlslspgeratlscrasqdiskylnwyqqkpgqaprlliyhtsrlhs<br>giparfsgsgsgtdytltisslqpedfavyfcqqgntlpytfgqgtkleikggggs<br>ggggsggggsqvqlqesgpglvkpsetlsltctvsgvslpdygvswirqppgkgle<br>wigviwgsettyyqsslksrvtiskdnsknqvslklssvtaadtavyycakhyyyg<br>gsyamdywgqgtlvtvss |
| 103102<br>CAR2 -<br>Soluble<br>scFv - nt | 62 | atggcctcccctgtcaccgcccctgctgcttccgctggctcttctgctccacgccgc<br>tcggcccgaaattgtgatgacccagtcacccgccactcttagcctttcacccggtg<br>agcgcgcaaccctgtcttgcagagcctcccaagacatctcaaaatacc ttaattgg<br>tatcaacagaagcccggacaggctcctcgccttctgatctaccacaccagccggct<br>ccattctggaatccctgccaggttcagcggtagcggatctgggaccgactacaccc<br>tcactatcagctcactgcagccagaggacttcgctgtctatttctgtcagcaaggg<br>aacacccctgccctacacctttggacagggcaccaagctcgagattaaaggtggagg<br>tggcagcggaggaggtgggtccggcggtggaggaagccaggtccaactccaagaaa<br>gcggaccgggtcttgtgaagccatcagaaactctttcactgacttgtactgtgagc<br>ggagtgtctctccccgattacggggtgtcttggatcagacagccaccggggaaggg<br>tctggaatggattggagtgatttggggctctgagactacttactaccaatcatccc<br>tcaagtcacgcgtcaccatctcaaaggacaactctaagaatcaggtgtcactgaaa<br>ctgtcatctgtgaccgcagccgacaccgccgtgtactattgcgctaagcattacta<br>ttatggcgggagctacgcaatggattactggggacagggtactctggtcaccgtgt<br>ccagccaccaccatcatcaccatcaccat |
| 103102<br>CAR2 -<br>Soluble<br>scFv - aa | 74 | MALPVTALLLPLALLLHAARPeivmtqspatlslspgeratlscrasqdiskylnw<br>yqqkpgqaprlliyhtsrlhsgiparfsgsgsgtdytltisslqpedfavyfcqqg<br>ntlpytfgqgtkleikggggsggggsggggsqvqlqesgpglvkpsetlsltctvs<br>gvslpdygvswirqppgkglewigviwgsettyyqsslksrvtiskdnsknqvslk<br>lssvtaadtavyycakhyyyggsyamdywgqgtlvtvsshhhhhhhh |
| 104876<br>CAR 2 -<br>Full - nt | 86 | atggcctcccctgtcaccgcccctgctgcttccgctggctcttctgctccacgccgc<br>tcggcccgaaattgtgatgacccagtcacccgccactcttagcctttcacccggtg<br>agcgcgcaaccctgtcttgcagagcctcccaagacatctcaaaataccttaattgg<br>tatcaacagaagcccggacaggctcctcgccttctgatctaccacaccagccggct<br>ccattctggaatccctgccaggttcagcggtagcggatctgggaccgactacaccc<br>tcactatcagctcactgcagccagaggacttcgctgtctatttctgtcagcaaggg<br>aacacccctgccctacacctttggacagggcaccaagctcgagattaaaggtggagg<br>tggcagcggaggaggtgggtccggcggtggaggaagccaggtccaactccaagaaa<br>gcggaccgggtcttgtgaagccatcagaaactctttcactgacttgtactgtgagc<br>ggagtgtctctccccgattacggggtgtcttggatcagacagccaccggggaaggg<br>tctggaatggattggagtgatttggggctctgagactacttactaccaatcatccc<br>tcaagtcacgcgtcaccatctcaaaggacaactctaagaatcaggtgtcactgaaa<br>ctgtcatctgtgaccgcagccgacaccgccgtgtactattgcgctaagcattacta<br>ttatggcgggagctacgcaatggattactggggacagggtactctggtcaccgtgt<br>ccagcaccactaccccagcaccgaggccacccaccccggctcctaccatcgcctcc<br>cagcctctgtccctgcgtccggaggcatgtagacccgcagctggtggggccgtgca<br>tacccggggtcttgacttcgcctgcgatatctacatttgggcccctctggctggta<br>cttgcggggtcctgctgctttcactcgtgatcactctttactgtaagcgcggtcgg<br>aagaagctgctgtacatctttaagcaaccct tcatgaggcctgtgcagactactca<br>agaggaggacggctgttcatgccggttcccagaggaggaggaaggcggctgcgaac |

TABLE 2-continued

Humanized CD19 CAR Constructs

| Name | SEQ ID | Sequence |
|---|---|---|
| | | tgcgcgtgaaattcagccgcagcgcagatgctccagcctacaagcaggggcagaac cagctctacaacgaactcaatcttggtcggagagaggagtacgacgtgctggacaa gcggagaggacgggacccagaaatgggcgggaagccgcgcagaaagaatccccaag agggcctgtacaacgagctccaaaaggataagatggcagaagcctatagcgagatt ggtatgaaaggggaacgcagaagaggcaaaggccacgacggactgtaccagggact cagcaccgccaccaaggacacctatgacgctcttcacatgcaggccctgccgcctc gg |
| 104876 CAR 2 - Full - aa | 32 | MALPVTALLLPLALLLHAARPeivmtqspatlslspgeratlscrasqdiskylnw yqqkpgqaprlliyhtsrlhsgiparfsgsgsgtdytltisslqpedfavyfcqqq ntlpytfgqgtkleikggggsggggsggggsqvqlqesgpglvkpsetlsltctvs gvslpdygvswirqppgkglewigviwgsettyyqsslksrvtiskdnsknqvslk lssvtaadtavyycakhyyyggsyamdywgqgtlvtvssttttpaprpptpaptias qplslrpeacrpaaggavhtrgldfacdiyiwaplagtcgvlllslvitlyckrgr kkllyifkqpfmrpvqttqeedgcscrfpeeeeggcelrvkfsrsadapaykqgqn qlynelnlgrreeydvldkrrgrdpemggkprrknpqeglynelqkdkmaeaysei gmkgerrrgkghdglyqglstatkdtydalhmqalppr |

CAR 3

| Name | SEQ ID | Sequence |
|---|---|---|
| CAR3 scFv domain | 3 | qvqlqesgpglvkpsetlsltctvsgvslpdygvswirqppgkglewigviwgset tyyssslksrvtiskdnsknqvslklssvtaadtavyycakhyyyggsyamdywgq gtlvtvssggggsggggsggggseivmtqspatlslspgeratlscrasqdiskyl nwyqqkpgqaprlliyhtsrlhsgiparfsgsgsgtdytltisslqpedfavyfcq qgntlpytfgqgtkleik |
| 103104 CAR 3 - Soluble scFv - nt | 63 | atggctctgccgtgaccgcactcctcctgccactggctctgctgcttcacgccgc tcgcccacaagtccagcttcaagaatcaggcctggtctggtgaagccatctgaga ctctgtccctcacttgcaccgtgagcggagtgtccctcccagactacggagtgagc tggattagacagcctcccggaaagggactggagtggatcggagtgatttggggtag cgaaaccacttactattcatcttccctgaagtcacgggtcaccatttcaaaggata actcaaagaatcaagtgagcctcaagctctcatcagtcaccgccgctgacaccgcc gtgtattactgtgccaagcattactactatggagggtcctacgccatggactactg gggccagggaactctggtcactgtgtcatctggtggaggaggtagcggaggaggcg ggagcggtggaggtggctccgaaatcgtgatgacccagagccctgcaaccctgtcc ctttctcccggggaacgggctacccttttcttgtcgggcatcacaagatatctcaaa atacctcaattggtatcaacagaagccgggacaggcccctaggcttcttatctacc acacctctcgcctgcatagcgggattcccgcacgctttagcgggtctggaagcggg accgactacactctgaccatctcatctctccagcccgaggacttcgccgtctactt ctgccagcagggtaacaccctgccgtacaccttcggccagggcaccaagcttgaga tcaaacatcaccaccatcatcaccatcac |
| 103104 CAR 3 - Soluble scFv - aa | 75 | MALPVTALLLPLALLLHAARPqvqlqesgpglvkpsetlsltctvsgvslpdygvs wirqppgkglewigviwgsettyyssslksrvtiskdnsknqvslklssvtaadta vyycakhyyyggsyamdywgqgtlvtvssggggsggggsggggseivmtqspatls lspgeratlscrasqdiskylnwyqqkpgqaprlliyhtsrlhsgiparfsgsgsg tdytltisslqpedfavyfcqqgntlpytfgqgtkleikhhhhhhhh |
| 104877 CAR 3 - Full - nt | 87 | atggctctgccgtgaccgcactcctcctgccactggctctgctgcttcacgccgc tcgcccacaagtccagcttcaagaatcaggcctggtctggtgaagccatctgaga ctctgtccctcacttgcaccgtgagcggagtgtccctcccagactacggagtgagc tggattagacagcctcccggaaagggactggagtggatcggagtgatttggggtag cgaaaccacttactattcatcttccctgaagtcacgggtcaccatttcaaaggata actcaaagaatcaagtgagcctcaagctctcatcagtcaccgccgctgacaccgcc gtgtattactgtgccaagcattactactatggagggtcctacgccatggactactg gggccagggaactctggtcactgtgtcatctggtggaggaggtagcggaggaggcg ggagcggtggaggtggctccgaaatcgtgatgacccagagccctgcaaccctgtcc ctttctcccggggaacgggctacccttttcttgtcgggcatcacaagatatctcaaa atacctcaattggtatcaacagaagccgggacaggcccctaggcttcttatctacc acacctctcgcctgcatagcgggattcccgcacgctttagcgggtctggaagcggg accgactacactctgaccatctcatctctccagcccgaggacttcgccgtctactt ctgccagcagggtaacaccctgccgtacaccttcggccagggcaccaagcttgaga tcaaaaccactactcccgctccaaggccacccaccccctgccccgaccatcgcctct cagccgctttcctcgctccggaggcatgtagacccgcagctggtggggccgtgca tacccggggtcttgacttcgcctgcgatatctacatttgggcccctctggctggta cttgcggggtcctgctgctttcactcgtgatcactctttactgtaagcgcggtcgg aagaagctgctgtacatcttaagcaacccttcatgaggcctgtgcagactactca agaggaggacggctgttcatgccggttcccagaggaggaggaaggcggctgcgaac tgcgcgtgaaattcagccgcagcgcagatgctccagcctacaagcaggggcagaac cagctctacaacgaactcaatcttggtcggagagaggagtacgacgtgctggacaa gcggagaggacgggacccagaaatgggcgggaagccgcgcagaaagaatccccaag agggcctgtacaacgagctccaaaaggataagatggcagaagcctatagcgagatt ggtatgaaaggggaacgcagaagaggcaaaggccacgacggactgtaccagggact cagcaccgccaccaaggacacctatgacgctcttcacatgcaggccctgccgcctc gg |

TABLE 2-continued

Humanized CD19 CAR Constructs

| Name | SEQ ID | Sequence |
|---|---|---|
| 104877 CAR 3 - Full - aa | 33 | MALPVTALLLPLALLLHAARPqvqlqesgpglvkpsetlsltctvsgvslpdygvs wirqppgkglewigviwgsettyyssslksrvtiskdnsknqvslklssvtaadta vyycakhyyyggsyamdywgqgtlvtvssggggsggggsggggseivmtqspatls lspgeratlscrasqdiskylnwyqqkpgqaprlliyhtsrlhsgiparfsgsgsg tdytltisslqpedfavyfcqqgntlpytfgqgtkleiktttpaprpptpaptias qplslrpeacrpaaggavhtrgldfacdiyiwaplagtcgvlllslvitlyckrgr kkllyifkqpfmrpvqttqeedgcscrfpeeeeggcelrvkfsrsadapaykqgqn qlynelnlgrreeydvldkrrgrdpemggkprrknpqeglynelqkdkmaeaysei gmkgerrrgkghdglyqglstatkdtydalhmqalppr |

CAR 4

| Name | SEQ ID | Sequence |
|---|---|---|
| CAR4 scFv domain | 4 | qvqlqesgpglvkpsetlsltctvsgvslpdygvswirqppgkglewigviwgset tyyqsslksrvtiskdnsknqvslklssvtaadtavyycakhyyyggsyamdywgq gtlvtvssggggsggggsggggseivmtqspatlslspgeratlscrasqdiskyl nwyqqkpgqaprlliyhtsrlhsgiparfsgsgsgtdytltisslqpedfavyfcq qgntlpytfgqgtkleik |
| 103106 CAR4 - Soluble scFv - nt | 64 | atggctctgccgtgaccgcactcctcctgccactggctctgctgcttcacgccgc tcgcccacaagtccagcttcaagaatcagggcctggtctggtgaagccatctgaga ctctgtccctcacttgcaccgtgagcggagtgtccctcccagactacggagtgagc tggattagacagcctcccggaaagggactggagtggatcggagtgatttgggtag cgaaaccacttactatcaatcttccctgaagtcacgggtcaccattttcaaaggata actcaaagaatcaagtgagcctcaagctctcatcagtcaccgccgctgacaccgcc gtgtattactgtgccaagcattactactatggaggtcctacgccatggactactg gggccagggaactctggtcactgtgtcatcggtggaggaggtagcggaggaggcg ggagcggtggaggtggctccgaaatcgtgatgacccagagccctgcaaccctgtcc ctttctcccggggaacgggctacccttcttgtcgggcatcacaagatatctcaaa atacctcaattggtatcaacagaagccgggacaggcccctaggcttcttatctacc acacctctcgcctgcatagcgggattcccgcacgctttagcgggtctggaagcggg accgactacactctgaccatctcatctctccagcccgaggacttcgccgtctactt ctgccagcagggtaacaccctgccgtacaccttcggccagggcaccaagcttgaga tcaaacatcaccaccatcatcaccatcac |
| 103106 CAR4 - Soluble scFv - aa | 76 | MALPVTALLLPLALLLHAARPqvqlqesgpglvkpsetlsltctvsgvslpdygvs wirqppgkglewigviwgsettyyqsslksrvtiskdnsknqvslklssvtaadta vyycakhyyyggsyamdywgqgtlvtvssggggsggggsggggseivmtqspatls lspgeratlscrasqdiskylnwyqqkpgqaprlliyhtsrlhsgiparfsgsgsg tdytltisslqpedfavyfcqqgntlpytfgqgtkleikhhhhhhhh |
| 104878 CAR 4 - Full - nt | 88 | atggctctgccgtgaccgcactcctcctgccactggctctgctgcttcacgccgc tcgcccacaagtccagcttcaagaatcagggcctggtctggtgaagccatctgaga ctctgtccctcacttgcaccgtgagcggagtgtccctcccagactacggagtgagc tggattagacagcctcccggaaagggactggagtggatcggagtgatttgggtag cgaaaccacttactatcaatcttccctgaagtcacgggtcaccattttcaaaggata actcaaagaatcaagtgagcctcaagctctcatcagtcaccgccgctgacaccgcc gtgtattactgtgccaagcattactactatggaggtcctacgccatggactactg gggccagggaactctggtcactgtgtcatcggtggaggaggtagcggaggaggcg ggagcggtggaggtggctccgaaatcgtgatgacccagagccctgcaaccctgtcc ctttctcccggggaacgggctacccttcttgtcgggcatcacaagatatctcaaa atacctcaattggtatcaacagaagccgggacaggcccctaggcttcttatctacc acacctctcgcctgcatagcgggattcccgcacgctttagcgggtctggaagcggg accgactacactctgaccatctcatctctccagcccgaggacttcgccgtctactt ctgccagcagggtaacaccctgccgtacaccttcggccagggcaccaagcttgaga tcaaaaccactactcccgctccaaggcacccacccctgccccgaccatcgcctct cagccgctttccctgcgtccggaggcatgtagacccgcagctggtggggccgtgca tacccggggtcttgacttcgcctgcgatatctactttgggcccctctggctggta cttgcggggtcctgctgctttcactcgtgatcactctttactgtaagcgcggtcgg aagaagctgctgtacatctttaagcaaccttcatgaggcctgtgcagactactca agaggaggacggctgttcatgccggttcccagaggaggaggaaggcggctgcgaac tgcgcgtgaaattcagccgcagcgcagatgctccagcctacaagcagggcagaac cagctctacaacgaactcaatcttggtcggagagaggagtacgacgtgctggacaa gcggagaggacgggacccagaaatgggcggaagccgcgcagaaagaatcccaag agggcctgtacaacgagctccaaaaggataagatggcagaacctatagcgagatt ggtatgaaagggaacgcagaagaggcaaaggccacgacggactgtaccagggact cagcaccgccaccaaggacacctatgacgctcttcacatgcaggccctgccgctc gg |
| 104878 CAR 4 - Full - aa | 34 | MALPVTALLLPLALLLHAARPqvqlqesgpglvkpsetlsltctvsgvslpdygvs wirqppgkglewigviwgsettyyqsslksrvtiskdnsknqvslklssvtaadta vyycakhyyyggsyamdywgqgtlvtvssggggsggggsggggseivmtqspatls lspgeratlscrasqdiskylnwyqqkpgqaprlliyhtsrlhsgiparfsgsgsg tdytltisslqpedfavyfcqqgntlpytfgqgtkleiktttpaprpptpaptias qplslrpeacrpaaggavhtrgldfacdiyiwaplagtcgvlllslvitlyckrgr |

TABLE 2-continued

Humanized CD19 CAR Constructs

| Name | SEQ ID | Sequence |
|---|---|---|
| | | kkllyifkqpfmrpvqttqeedgcscrfpeeeeggcelrvkfsrsadapaykqgqn<br>qlynelnlgrreeydvldkrrgrdpemggkprrknpqeglynelqkdkmaeaysei<br>gmkgerrrgkghdglyqglstatkdtydalhmqalppr |

CAR 5

| CAR5 scFv domain | 5 | eivmtqspatlslspgeratlscrasqdiskylnwyqqkpgqaprlliyhtsrlhs<br>giparfsgsgsgtdytltisslqpedfavyfcqqgntlpytfgqgtkleikggggs<br>ggggsggggsggggsqvqlqesgpglvkpsetlsltctvsgvslpdygvswirqpp<br>gkglewigviwgsettyyssslksrvtiskdnsknqvslklssvtaadtavyycak<br>hyyyggsyamdywgqgtlvtvss |
| 99789<br>CAR5 -<br>Soluble<br>scFv - nt | 65 | atggccctcccagtgaccgctctgctgctgcctctcgcacttcttctccatgccgc<br>tcggcctgagatcgtcatgacccaaagcccgctaccctgtccctgtcacccggcg<br>agagggcaacccttcatgcagggccagccaggacatttctaagtacctcaactgg<br>tatcagcagaagccagggcaggctcctcgcctgctgatctaccacaccagccgcct<br>ccacagcgtatccccgccagattttcggggagcgggtctggaaccgactacaccc<br>tcaccatctcttctctgcagcccgaggatttcgccgtctatttctgccagcaggg<br>aatactctgcctacaccttcggtcaaggtaccaagctggaaatcaagggaggcgg<br>aggatcaggcggtggcggaagcggaggaggtggctccggaggaggaggttcccaag<br>tgcagcttcaagaatcaggacccggacttgtgaagccatcagaaacctctccctg<br>acttgtaccgtgtccggtgtgagcctccccgactacggagtctcttggattcgcca<br>gcctccggggaagggtcttgaatggattggggtgatttggggatcagagactactt<br>actactcttcatcacttaagtcacgggtcaccatcagcaaagataatagcaagaac<br>caagtgtcacttaagctgtcatctgtgaccgccgctgacaccgccgtgtactattg<br>tgccaaacattactattacggaggtcttatgctatggactactgggacaggggga<br>ccctggtgactgtctctagccatcaccatcaccaccatcatcac |
| 99789<br>CAR5 -<br>Soluble<br>scFv - aa | 77 | MALPVTALLLPLALLLHAARPeivmtqspatlslspgeratlscrasqdiskylnw<br>yqqkpgqaprlliyhtsrlhsgiparfsgsgsgtdytltisslqpedfavyfcqqg<br>ntlpytfgqgtkleikggggsggggsggggsggggsqvqlqesgpglvkpsetlsl<br>tctvsgvslpdygvswirqppgkglewigviwgsettyyssslksrvtiskdnskn<br>qvslklssvtaadtavyycakhyyyggsyamdywgqgtlvtvsshhhhhhhh |
| 104879<br>CAR 5 -<br>Full - nt | 89 | atggccctccctgtcaccgccctgctgcttccgctggctcttctgctccacgccgc<br>tcggcccgaaattgtgatgacccagtcaccgccactcttagcctttcacccggtg<br>agcgcgcaaccctgtcttgcagagcctcccaagacatctcaaatacttaattgg<br>tatcaacagaagcccggacaggctcctcgccttctgatctaccacaccagccgct<br>ccattctggaatccctgccaggttcagcggtagcggatctggaccgactacaccc<br>tcactatcagctcactgcagccagaggacttcgctgtctatttctgtcagcaaggg<br>aacaccctgccctacacctttggacagggcaccaagctcgagattaaaggtggagg<br>tggcagcggaggaggtgggtccggcggtggaggaagcggcggaggcgggagccagg<br>tccaactccaagaaagcggaccgggtcttgtgaagccatcagaaactctttcactg<br>acttgtactgtgagcggagtgtctctccccgattacggggtgtcttggatcagaca<br>gccaccggggaagggtctggaatggattggagtgatttggggctctgagactactt<br>actactcttcatccctcaagtcacgcgtcaccatctcaaaggacaactctaagaat<br>caggtgtcactgaaactgtcatctgtgaccgcagccgacaccgccgtgtactattg<br>cgctaagcattactattatggcgggagctacgcaatggattactggggacagggta<br>ctctggtcaccgtgtccagcaccactacccagcaccgaggccacccaccccggct<br>cctaccatcgcctcccagcctctgtccctgcgtccggaggcatgtagacccgcagc<br>tggtggggccgtgcataccggggtcttgacttcgcctgccctgcgatatctacatttggg<br>cccctctggctggtacttgcggggtcctgctgctttcactcgtgatcactctttac<br>tgtaagcgcggtcggaagaagctgctgtacatcttttaagcaacccttcatgaggcc<br>tgtgcagactactcaagaggaggacggctgttcatgccggttcccagaggaggagg<br>aaggcggctgcgaactgcgcgtgaaattcagccgcagcgcagatgctccagcctac<br>aagcaggggcagaaccagctctacaacgaactcaatcttggtcggagagaggagta<br>cgacgtgctggacaagcggagaggacgggacccagaaatgggcgggaagccgcgca<br>gaaagaatccccaagagggcctgtacaacgagctccaaaaggataagatggcagaa<br>gcctatagcgagattggtatgaaagggggaacgcagaagaggcaaaggccacgacgg<br>actgtaccagggactcagcaccgccaccaaggacacctatgacgctcttcacatgc<br>aggccctgccgcctcgg |
| 104879<br>CAR 5 -<br>Full - aa | 35 | MALPVTALLLPLALLLHAARPeivmtqspatlslspgeratlscrasqdiskylnw<br>yqqkpgqaprlliyhtsrlhsgiparfsgsgsgtdytltisslqpedfavyfcqqg<br>ntlpytfgqgtkleikggggsggggsggggsggggsqvqlqesgpglvkpsetlsl<br>tctvsgvslpdygvswirqppgkglewigviwgsettyyssslksrvtiskdnskn<br>qvslklssvtaadtavyycakhyyyggsyamdywgqgtlvtvssttttpaprpptpa<br>ptiasqplslrpeacrpaaggavhtrgldfacdiyiwaplagtcgvlllslvitly<br>ckrgrkkllyifkqpfmrpvqttqeedgcscrfpeeeeggcelrvkfsrsadapay<br>kqgqnqlynelnlgrreeydvldkrrgrdpemggkprrknpqeglynelqkdkmae<br>ayseigmkgerrrgkghdglyqglstatkdtydalhmqalppr |

CAR 6

| CAR6<br>scFv | 6 | eivmtqspatlslspgeratlscrasqdiskylnwyqqkpgqaprlliyhtsrlhs<br>giparfsgsgsgtdytltisslqpedfavyfcqqgntlpytfgqgtkleikgggs |

TABLE 2-continued

Humanized CD19 CAR Constructs

| Name | SEQ ID | Sequence |
|---|---|---|
| domain | | ggggsggggsggggsqvqlqesgpglvkpsetlsltctvsgvslpdygvswirqpp<br>gkglewigviwgsettyyqsslksrvtiskdnsknqvslklssvtaadtavyycak<br>hyyyggsyamdywgqgtlvtvss |
| 99790<br>CAR6 –<br>Soluble<br>scFv – nt | 66 | atggcctcccagtgaccgctctgctgctgcctctcgcacttcttctccatgccgc<br>tcggcctgagatcgtcatgacccaaagcccgctaccctgtccctgtcacccggcg<br>agagggcaacccttttcatgcagggccagccaggacatttctaagtacctcaactgg<br>tatcagcagaagccagggcaggctcctcgcctgctgatctaccacaccagccgcct<br>ccacagcggtatccccgccagattttccgggagcgggtctggaaccgactacaccc<br>tcaccatctcttctctgcagcccgaggattcgccgtctatttctgccagcagggg<br>aatactctgccgtacaccttcggtcaaggtaccaagctggaaatcaagggaggcgg<br>aggatcaggcggtggcggaagcggaggaggtggctccggaggaggaggttcccaag<br>tgcagcttcaagaatcaggacccggacttgtgaagccatcagaaaccctctccctg<br>acttgtaccgtgtccggtgtgagcctccccgactacggagtctcttggattcgcca<br>gcctccggggaagggtcttgaatggattgggtgatttgggatcagagactactt<br>actaccagtcatcacttaagtcacgggtcaccatcagcaaagataatagcaagaac<br>caagtgtcacttaagctgtcatctgtgaccgccgctgacaccgccgtgtactattg<br>tgccaaacattactattacggagggtcttatgctatggactactggggacagggga<br>ccctggtgactgtctctagccatcaccatcaccaccatcatcac |
| 99790<br>CAR6 –<br>Soluble<br>scFv – aa | 78 | MALPVTALLLPLALLLHAARPeivmtqspatlslspgeratlscrasqdiskylnw<br>yqqkpgqaprlliyhtsrlhsgiparfsgsgsgtdytltisslqpedfavyfcqqg<br>ntlpytfgqgtkleikggggsggggsggggsggggsqvqlqesgpglvkpsetlsl<br>tctvsgvslpdygvswirqppgkglewigviwgsettyyqsslksrvtiskdnskn<br>qvslklssvtaadtavyycakhyyyggsyamdywgqgtlvtvsshhhhhhhh |
| 104880<br>CAR6 –<br>Full – nt | 90 | atggcctccctgtcaccgcctgctgcttccgctggctcttctgctccacgccgc<br>tcggcccgaaattgtgatgacccagtcacccgccactcttagcctttcacccggtg<br>agcgcgcaaccctgtcttgcagagcctcccaagacatctcaaatacctttaattgg<br>tataacagaagcccggacaggctcctcgccttctgatctaccacaccagccgcct<br>ccattctggaatccctgccaggttcagcggtagcggatctgggaccgactacaccc<br>tcactatcagctcactgcagccagaggacttcgctgtctatttctgtcagcaaggg<br>aacacccctgccctacacctttggacagggcaccaagctcgagattaaaggtggagg<br>tggcagcggagaggtgggtccggcggtggaggaagcggaggcggagggagccagg<br>tccaactccaagaaagcggaccgggtcttgtgaagccatcagaaactctttcactg<br>acttgtactgtgagcggagtgtctctcccgattacggggtgtcttggatcagaca<br>gccaccggggaagggtctggaatggattggagtgatttgggctctgagactactt<br>actaccaatcatccctcaagtcacgcgtcaccatctcaaaggacaactctaagaat<br>caggtgtcactgaaactgtcatctgtgaccgcagccgacaccgccgtgtactattg<br>cgctaagcattactattatggcgggagctacgaatggattactggggacagggta<br>ctctggtcaccgtgtccagcaccactacccagcaccgaggccacccacccggct<br>cctaccatcgcctcccagcctctgtccctgcgtccggaggcatgtagaccgcagc<br>tggtgggccgtgcatacccgggggtcttgacttcgcctgcgatatctacattgg<br>cccctctggctggtacttgcggggtcctgctgcttcactcgtgatcactctttac<br>tgtaagcgcggtcggaagaagctgctgtacatctttaagcaaccttcatgaggcc<br>tgtcagactactcaagaggaggacggctgttcatgccggttcccagaggaggagg<br>aaggcggctgcgaactgcgcgtgaaattcagccgcagcgcagatgctccagcctac<br>aagcaggggcagaaccagctctacaacgaactcaatcttggtcggagagaggagta<br>cgacgtgctggacaagcggagaggacgggacccagaaatgggcgggaagccgcgca<br>gaaagaatccccaaggggcctgtacaacgagctccaaaaggataagatggcagaa<br>gcctatagcgagattggtatgaaggggaacgcagaagaggcaaaggccacgacgg<br>actgtaccagggactcagcaccgccaccaaggacacctatgacgctcttcacatgc<br>aggccctgccgcctcgg |
| 104880<br>CAR6 –<br>Full – aa | 36 | MALPVTALLLPLALLLHAARPeivmtqspatlslspgeratlscrasqdiskylnw<br>yqqkpgqaprlliyhtsrlhsgiparfsgsgsgtdytltisslqpedfavyfcqqg<br>ntlpytfgqgtkleikggggsggggsggggsggggsqvqlqesgpglvkpsetlsl<br>tctvsgvslpdygvswirqppgkglewigviwgsettyyqsslksrvtiskdnskn<br>qvslklssvtaadtavyycakhyyyggsyamdywgqgtlvtvssttttpaprpptpa<br>ptiasqplslrpeacrpaaggavhtrgldfacdiyiwaplagtcgvllllslvitly<br>ckrgrkllyifkqpfmrpvqttqeedgcscrfpeeeeggcelrvkfsrsadapay<br>kqgqnqlynelnlgrreeydvldkrrgrdpemggkprrknpqeglynelqkdkmae<br>ayseigmkgerrrgkghdglyqglstatkdtydalhmqalppr |

CAR 7

| CAR7 scFv<br>domain | 7 | qvqlqesgpglvkpsetlsltctvsgvslpdygvswirqppgkglewigviwgset<br>tyyssslksrvtiskdnsknqvslklssvtaadtavyycakhyyyggsyamdywgq<br>gtlvtvssggggsggggsggggsggggseivmtqspatlslspgeratlscrasqd<br>iskylnwyqqkpgqaprlliyhtsrlhsgiparfsgsgsgtdytltisslqpedfa<br>vyfcqqgntlpytfgqgtkleik |
| 100796<br>CAR7 –<br>Soluble<br>scFv – nt | 67 | atggcactgcctgtcactgccctcctgctgcctctggcctccttctgcatgccgc<br>caggcccaagtccagctgcaagagtcaggacccggactggtgaagccgtctgaga<br>ctctctcactgacttgtaccgtcagcggcgtgtccctcccgactacggagtgtca<br>tggatccgccaacctcccggggaagggcttgaatggattggtgtcatctgggggttc |

TABLE 2-continued

Humanized CD19 CAR Constructs

| Name | SEQ ID | Sequence |
|---|---|---|
| | | tgaaaccacctactactcatcttccctgaagtccagggtgaccatcagcaaggata<br>attccaagaaccaggtcagccttaagctgtcatctgtgaccgctgctgacaccgcc<br>gtgtattactgcgccaagcactactattacggaggaagctacgctatggactattg<br>gggacagggcactctcgtgactgtgagcagcggcggtggagggtctggaggtggag<br>gatccggtggtggtgggtcaggcggaggagggagcgagattgtgatgactcagtca<br>ccagccaccctttctctttcacccggcgagagagcaaccctgagctgtagagccag<br>ccaggacatttctaagtacctcaactggtatcagcaaaaaccggggcaggcccctc<br>gcctcctgatctaccatacctcacgccttcactctggtatcccgctcggtttagc<br>ggatcaggatctggtaccgactacactctgaccatttccagcctgcagccagaaga<br>tttcgcagtgtatttctgccagcagggcaataccttccttacaccttcggtcagg<br>gaaccaagctcgaaatcaagcaccatcaccatcatcaccaccat |
| 100796<br>CAR7 -<br>Soluble<br>scFv - aa | 79 | MALPVTALLLPLALLLHAARPqvqlqesgpglvkpsetlsltctvsgvslpdygvs<br>wirqppgkglewigviwgsettyyssslksrvtiskdnsknqvslklssvtaadta<br>vyycakhyyyggsyamdywgqgtlvtvssggggsggggsggggsggggseivmtqs<br>patlslspgeratlscrasqdiskylnwyqqkpgqaprlliyhtsrlhsgiparfs<br>gsgsgtdytltisslqpedfavyfcqqgntlpytfgqgtkleikhhhhhhhh |
| 104881<br>CAR 7<br>Full - nt | 91 | atggctctgccgtgaccgcactcctcctgccactggctctgctgcttcacgccgc<br>tcgcccacaagtccagcttcaagaatcaggcctggtctggtgaagccatctgaga<br>ctctgtccctcacttgcaccgtgagcggagtgtccctcccagactacggagtgca<br>tggattagacagcctcccggaaagggactggagtggatcggagtgatttggggtag<br>cgaaaccacttactattcatcttccctgaagtcacgggtcaccatttcaaaggata<br>actcaaagaatcaagtgagcctcaagctctcatcagtcaccgccgctgacaccgcc<br>gtgtattactgtgccaagcattactactatggagggtcctacgccatggactactg<br>gggccagggaactctggtcgtgtcatctggtggaggaggtagcggaggaggcg<br>ggagcggtggaggtggctccggaggtggcggaagcgaaatcgtgatgacccagagc<br>cctgcaaccctgtcccttctcccggggaacgggctaccctttcttgtcgggcatc<br>acaagatatctcaaaatacctcaattggtatcaacagaagccgggacaggcccta<br>ggcttcttatctaccacacctctcgcctgcatagcgggattcccgcacgctttagc<br>gggtctggaagcgggaccgactacactctgaccatctcatctccagcccgagga<br>cttcgccgtctacttctgccagcagggtaacaccctgcgtacaccttcggccagg<br>gcaccaagcttgagatcaaaaccactactcccgctccaaggccaccccacccctgcc<br>ccgaccatcgcctctcagccgctttccctgcgtccggaggcatgtagaccgcagc<br>tggtggggccgtgcatacccggggtcttgacttcgcctgcgatatctacatttggg<br>cccctctggctggtacttgcgggtcctgctgcttcactcgtgatcactcttttac<br>tgtaagcgcggtcggaagaagctgctgtacatctttaagcaacccttcatgaggcc<br>tgtcagactactcaagaggaggacggctgttcatgccggttcccagaggaggag<br>aaggcggctgcgaactgcgcgtgaaattcagccgcagcgcagatgctccagcctac<br>aagcaggggcagaaccagctctacaacgaactcaatcttggtcggagagaggagta<br>cgacgtgctggacaagcggagaggacgggacccagaaatgggcgggaagccgcgca<br>gaaagaatccccaagagggcctgtacaacgagctccaaaaggataagatggcagaa<br>gcctatagcgagattggtatgaaaggggaacgcagaagaggcaaaggccacgacgg<br>actgtaccagggactcagcaccgccaccaaggacacctatgacgctcttcacatgc<br>aggccctgccgcctcgg |
| 104881<br>CAR 7<br>Full - aa | 37 | MALPVTALLLPLALLLHAARPqvqlqesgpglvkpsetlsltctvsgvslpdygvs<br>wirqppgkglewigviwgsettyyssslksrvtiskdnsknqvslklssvtaadta<br>vyycakhyyyggsyamdywgqgtlvtvssggggsggggsggggsggggseivmtqs<br>patlslspgeratlscrasqdiskylnwyqqkpgqaprlliyhtsrlhsgiparfs<br>gsgsgtdytltisslqpedfavyfcqqgntlpytfgqgtkleiktttpaprpptpa<br>ptiasqplslrpeacrpaaggavhtrgldfacdiyiwaplagtcgvlllslvitly<br>ckrgrkkllyifkqpfmrpvqttqeedgcscrfpeeeeggcelrvkfsrsadapay<br>kqgqnqlynelnlgrreeydvldkrrgrdpemggkprrknpqeglynelqkdkmae<br>ayseigmkgerrrgkghdglyqglstatkdtydalhmqalppr |

CAR 8

| CAR8 scFv<br>domain | 8 | qvqlqesgpglvkpsetlsltctvsgvslpdygvswirqppgkglewigviwgset<br>tyyqsslksrvtiskdnsknqvslklssvtaadtavyycakhyyyggsyamdywgq<br>gtlvtvssggggsggggsggggsggggseivmtqspatlslspgeratlscrasqd<br>iskylnwyqqkpgqaprlliyhtsrlhsgiparfsgsgsgtdytltisslqpedfa<br>vyfcqqgntlpytfgqgtkleik |
| 100798<br>CAR8 -<br>Soluble<br>scFv - nt | 68 | atggcactgcctgtcactgccctcctgctgcctctggccctccttctgcatgccgc<br>caggccccaagtccagctgcaagagtcaggacccggactggtgaagccgtctgaga<br>ctctctcactgacttgtaccgtcagcggcgtgtccctcccgactacggagtgtca<br>tggatccgccaacctcccgggaaagggcttgaatggattggtgtcatctgggggttc<br>tgaaaccacctactaccagtcttccctgaagtccagggtgaccatcagcaaggata<br>attccaagaaccaggtcagccttaagctgtcatctgtgaccgctgctgacaccgcc<br>gtgtattactgcgccaagcactactattacggaggaagctacgctatggactattg<br>gggacagggcactctcgtgactgtgagcagcggcggtggagggtctggaggtggag<br>gatccggtggtggtgggtcaggcggaggagggagcgagattgtgatgactcagtca<br>ccagccaccctttctctttcacccggcgagagagcaaccctgagctgtagagccag<br>ccaggacatttctaagtacctcaactggtatcagcaaaaaccggggcaggcccctc<br>gcctcctgatctaccatacctcacgccttcactctggtatcccgctcggtttagc |

TABLE 2-continued

Humanized CD19 CAR Constructs

| Name | SEQ ID | Sequence |
|---|---|---|
| | | ggatcaggatctggtaccgactacactctgaccatttccagcctgcagccagaaga<br>tttcgcagtgtatttctgccagcagggcaataccttccttacaccttcggtcagg<br>gaaccaagctcgaaatcaagcaccatcaccatcatcatcaccac |
| 100798<br>CAR8 -<br>Soluble<br>scFv - aa | 80 | MALPVTALLLPLALLLHAARPqvqlqesgpglvkpsetlsltctvsgvslpdygvs<br>wirqppgkglewigviwgsettyyqsslksrvtiskdnsknqvslklssvtaadta<br>vyycakhyyyggsyamdywgqgtlvtvssggggsggggsggggsggggseivmtqs<br>patlslspgeratlscrasqdiskylnwyqqkpgqaprlliyhtsrlhsgiparfs<br>gsgsgtdytltisslqpedfavyfcqqgntlpytfgqgtkleikhhhhhhhh |
| 104882<br>CAR 8 -<br>Full - nt | 92 | atggctctgcccgtgaccgcactcctcctgccactggctctgctgcttcacgccgc<br>tcgcccacaagtccagcttcaagaatcaggggcctggtctggtgaagccatctgaga<br>ctctgtccctcacttgcaccgtgagcggagtgtccctcccagactacggagtgagc<br>tggattagacagcctcccggaaagggactggagtggatcggagtggatttgggtag<br>cgaaaccacttactatcaatcttccctgaagtcacgggtcaccatttcaaaggata<br>actcaaagaatcaagtgagcctcaagctctcatcagtcaccgccgctgacaccgcc<br>gtgtattactgtgccaagcattactactatggaggtcctacgccatggactactg<br>gggccagggaactctggtcactgtgtcatctggtggaggaggtagcggaggaggcg<br>ggagcggtggaggtggctccggaggcgtgggtcagaaatcgtgatgacccagagc<br>cctgcaacctgtcccttctccggggaacgggctacccttcttgtcgggcatc<br>acaagatatctcaaatacctcaattggtatcaacagaagccgggacaggcccta<br>ggcttcttatctaccacacctctcgcctgcatagcgggattcccgcacgctttagc<br>gggtctggaagcgggaccgactacactctgaccatctcatctctccagcccgagga<br>cttcgccgtctacttctgccagcagggtaacacccgcgtacaccttcggccagg<br>gcaccaagcttgagatcaaaaccactactcccgctccaaggccacccacccctgcc<br>ccgaccatcgcctctcagccgcttccctgctcggaggcatgtagacccgcagc<br>tggtggggccgtgcatacccggggtcttgacttcgcctgcgatatctacatttggg<br>cccctctggctggtacttgcggggtcctgctgctttcactcgtgatcactctttac<br>tgtaagcgcggtcggaagaagctgctgtacatcttaagcaacccttcatgaggcc<br>tgtgcagactactcaagaggaggacggctgttcatgccggttcccagaggaggagg<br>aaggcggctgcgaactgcgcgtgaaattcagccgcagcgcagatgctccagcctac<br>aagcaggggcagaaccagctctacaacgaactcaatcttggtcggagagaggagta<br>cgacgtgctggacaagcggagaggacgggacccagaaatgggcgggaagccgcgca<br>gaaagaatccccaagagggcctgtacaacgagctccaaaaggataagatggcagaa<br>gcctatagcgagattggtatgaaaggggaacgcagaagaggcaaaggccacgacgg<br>actgtaccagggactcagcaccgccaccaaggacacctatgacgctcttcacatgc<br>aggccctgccgcctcgg |
| 104882<br>CAR 8 -<br>Full - aa | 38 | MALPVTALLLPLALLLHAARPqvqlqesgpglvkpsetlsltctvsgvslpdygvs<br>wirqppgkglewigviwgsettyyqsslksrvtiskdnsknqvslklssvtaadta<br>vyycakhyyyggsyamdywgqgtlvtvssggggsggggsggggsggggseivmtqs<br>patlslspgeratlscrasqdiskylnwyqqkpgqaprlliyhtsrlhsgiparfs<br>gsgsgtdytltisslqpedfavyfcqqgntlpytfgqgtkleiktttpaprpptpa<br>ptiasqplslrpeacrpaaggavhtrgldfacdiyiwaplagtcgvlllslvitly<br>ckrgrkkllyifkqpfmrpvqttqeedgcscrfpeeeeggcelrvkfsrsadapay<br>kqgqnqlynelnlgrreeydvldkrrgrdpemggkprrknpqeglynelqkdkmae<br>ayseigmkgerrrgkghdglyqglstatkdtydalhmqalppr |

CAR 9

| CAR9 scFv<br>domain | 9 | eivmtqspatlslspgeratlscrasqdiskylnwyqqkpgqaprlliyhtsrlhs<br>giparfsgsgsgtdytltisslqpedfavyfcqqgntlpytfgqgtkleikggggs<br>ggggsggggsggggsqvqlqesgpglvkpsetlsltctvsgvslpdygvswirqpp<br>gkglewigviwgsettyynsslksrvtiskdnsknqvslklssvtaadtavyycak<br>hyyyggsyamdywgqgtlvtvss |
| 99789<br>CAR9 -<br>Soluble<br>scFv - nt | 69 | atggccctcccagtgaccgctctgctgctgcctctcgcacttcttctccatgccgc<br>tcggcctgagatcgtcatgacccaaagccccgctacctgtccctgtcacccggcg<br>agagggcaaccctttcatgcagggccagccaggacatttctaagtacctcaactgg<br>tatcagcagaagccagggcaggctcctcgcctgctgatctaccacaccagccgcct<br>ccacagcggtatccccgccagattttccgggagcgggtctggaaccgactacaccc<br>tcaccatctcttctctgcagcccgaggattcgccgtctatttctgccagcagggg<br>aatactctgccgtacaccttcggtcaaggtaccaagctggaaatcaagggaggcgg<br>aggatcaggcggtggcggaagcggaggaggtggctccggaggaggaggttcccaag<br>tgcagcttcaagaatcaggacccggacttgtgaagccatcagaaaccctctccctg<br>acttgtaccgtgtccggtgtgagcctcccgactacggagtctcttggattcgcca<br>gcctccggggaagggcttgaatggattggggtgatttgggatcagagactactt<br>actacaattcatcacttaagtcacgggtcaccatcagcaaagataatagcaagaac<br>caagtgtcacttaagctgtcatctgtgaccgccgctgacaccgccgtgtactattg<br>tgccaaacattactattacggaggtcttatgctatggactactgggacaggga<br>ccctggtgactgtctctagccatcaccatcaccaccatcatcac |
| 99789<br>CAR9 -<br>Soluble | 81 | MALPVTALLLPLALLLHAARPeivmtqspatlslspgeratlscrasqdiskylnw<br>yqqkpgqaprlliyhtsrlhsgiparfsgsgsgtdytltisslqpedfavyfcqqg<br>ntlpytfgqgtkleikggggsggggsggggsggggsqvqlqesgpglvkpsetlsl |

TABLE 2-continued

Humanized CD19 CAR Constructs

| Name | SEQ ID | Sequence |
|---|---|---|
| scFv - aa | | tctvsgvslpdygvswirqppgkglewigviwgsettyynsslksrvtiskdnskn<br>qvslklssvtaadtavyycakhyyyggsyamdywgqgtlvtvsshhhhhhhh |
| 105974<br>CAR 9 -<br>Full - nt | 93 | atggccctccctgtcaccgccctgctgcttccgctggctcttctgctccacgccgc<br>tcggcccgaaattgtgatgacccagtcaccgccactcttagcctttcaccggtg<br>agcgcgcaaccctgtcttgcagagcctcccaagacatctcaaaataccttaattgg<br>tatcaacagaagcccggacaggctcctcgccttctgatctaccacaccagccggct<br>ccattctggaatccctgccaggttcagcggtagcggatctgggaccgactacaccc<br>tcactatcagctcactgcagccagaggacttcgctgtctatttctgtcagcaaggg<br>aacaccctgccctacacctttggacagggcaccaagctcgagattaaaggtggagg<br>tggcagcggaggaggtgggtccggcggtggaggaagcggaggcggtgggagccagg<br>tccaactccaagaaagcggaccgggtcttgtgaagccatcagaaactctttcactg<br>acttgtactgtgagcggagtgtctctccccgattacggggtgtcttggatcagaca<br>gccaccggggaagggtctggaatggattggagtgatttgggcgtctgagactactt<br>actacaactcatccctcaagtcacgcgtcaccatctcaaaggacaactctaagaat<br>caggtgtcactgaaactgtcatctgtgaccgcagccgacaccgccgtgtactattg<br>cgctaagcattactattatggcgggagctacgcaatgattactggggacagggta<br>ctctggtcaccgtgtccagcaccactaccccagcaccgaggccacccaccccggct<br>cctaccatcgctcccagcctctgtccctgctccggaggcatgtagaccccgcagc<br>tggtgggccgtgcatacccgggtcttgacttcgcctgcgatatctacatttggg<br>ccctctggctggtacttgcggggtcctgctgctttcactcgtgatcactctttac<br>tgtaagcgcggtcggaagaagctgctgtacatctttaagcaaccttcatgaggcc<br>tgtgcagactactcaagaggaggacggctgttcatgccggttcccagaggaggagg<br>aaggcggctgcgaactgcgcgtgaaattcagccgcagcgcagatgctccagcctac<br>aagcaggggcagaaccagctctacaacgaactcaatcttggtcggagagaggagta<br>cgacgtgctggacaagcggagaggacgggacccagaaatggcgggaagccgcgca<br>gaaagaatccccaagagggcctgtacaacgagctccaaaaggataagatggcagaa<br>gcctatagcgagattggtatgaaagggaacgcagaagaggcaaaggccacgacgg<br>actgtaccagggactcagcaccgccaccaaggacacctatgacgctcttcacatgc<br>aggccctgccgcctcgg |
| 105974<br>CAR 9 -<br>Full - aa | 39 | MALPVTALLLPLALLLHAARPeivmtqspatlslspgeratlscrasqdiskylnw<br>yqqkpgqaprlliyhtsrlhsgiparfsgsgsgtdytltisslqpedfavyfcqqg<br>ntlpytfgqgtkleikgsgggsggggsggggsggggsqvqlqesgpglvkpsetlsl<br>tctvsgvslpdygvswirqppgkglewigviwgsettyynsslksrvtiskdnskn<br>qvslklssvtaadtavyycakhyyyggsyamdywgqgtlvtvssttttpaprpptpa<br>ptiasqplslrpeacrpaaggavhtrgldfacdiyiwaplagtcgvlllslvitly<br>ckrgrkllyifkqpfmrpvqttqeedgcscrfpeeeeggcelrvkfsrsadapay<br>kqgqnqlynelnlgrreeydvldkrrgrdpemggkprrknpqeglynelqkdkmae<br>ayseigmkgerrrgkghdglyqglstatkdtydalhmqalppr |

CAR10

| CAR10<br>scFv<br>domain | 10 | qvqlqesgpglvkpsetlsltctvsgvslpdygvswirqppgkglewigviwgset<br>tyynsslksrvtiskdnsknqvslklssvtaadtavyycakhyyyggsyamdywgq<br>gtlvtvssgggggsggggsggggsggggseivmtqspatlslspgeratlscrasqd<br>iskylnwyqqkpgqaprlliyhtsrlhsgiparfsgsgsgtdytltisslqpedfa<br>vyfcqqgntlpytfgqgtkleik |
| 100796<br>CAR10 -<br>Soluble<br>scFv - nt | 70 | atggcactgcctgtcactgccctcctgctgcctctggccctcttctgcatgccgc<br>caggcccccaagtccagctgcaagagtcaggacccggactggtgaagccgtctgaga<br>ctctctcactgacttgtaccgtcagcggcgtgtccctcccgactacggagtgtca<br>tggatccgccaacctcccgggaagggcttgaatggattggtgtcatctggggttc<br>tgaaaccacctactacaactcttccctgaagtccagggtgaccatcagcaaggata<br>attccaagaaccaggtcagccttaagctgtcatctgtgaccgctgctgacaccgcc<br>gtgtattactgcgccaagcactactattacggaggaagctacgctatggactattg<br>gggacagggcactctcgtgactgtgagcagcggcggtggagggtctggaggtggag<br>gatccggtggtggtgggtcaggcggaggagggagcgagattgtgatgactcagtca<br>ccagccaccctttctctttcaccccgcgagagaagcaaccctgagctgtagagccag<br>ccaggacatttctaagtacctcaactggtatcagcaaaaccggggcaggccctc<br>gcctcctgatctaccatacctcacgccttcactctggtatcccgctcggtttagc<br>ggatcaggatctggtaccgactacactctgaccatttccagcctgcagccagaaga<br>tttcgcagtgtatttctgccagcagggcaataccttccttacaccttcggtcagg<br>gaaccaagctcgaaatcaagcaccatcaccatcaccaccat |
| 100796<br>CAR10 -<br>Soluble<br>scFv - aa | 82 | MALPVTALLLPLALLLHAARPqvqlqesgpglvkpsetlsltctvsgvslpdygvs<br>wirqppgkglewigviwgsettyynsslksrvtiskdnsknqvslklssvtaadta<br>vyycakhyyyggsyamdywgqgtlvtvssgggggsggggsggggsggggseivmtqs<br>patlslspgeratlscrasqdiskylnwyqqkpgqaprlliyhtsrlhsgiparfs<br>gsgsgtdytltisslqpedfavyfcqqgntlpytfgqgtkleikhhhhhhhh |
| 105975<br>CAR 10<br>Full - nt | 94 | atggccctccctgtcaccgccctgctgcttccgctggctcttctgctccacgccgc<br>tcggcccgaaattgtgatgacccagtcaccgccactcttagcctttcaccggtg<br>agcgcgcaaccctgtcttgcagagcctcccaagacatctcaaaataccttaattgg<br>tatcaacagaagcccggacaggctcctcgccttctgatctaccacaccagccggct<br>ccattctggaatccctgccaggttcagcggtagcggatctgggaccgactacaccc |

TABLE 2-continued

Humanized CD19 CAR Constructs

| Name | SEQ ID | Sequence |
|---|---|---|
| | | tcactatcagctcactgcagccagaggacttcgctgtctatttctgtcagcaaggg<br>aacaccctgccctacacctttggacagggcaccaagctcgagattaaaggtggagg<br>tggcagcggaggaggtgggtccggcggtggaggaagcggaggcggtgggagccagg<br>tccaactccaagaaagcggaccgggtcttgtgaagccatcagaaactctttcactg<br>acttgtactgtgagcggagtgtctctccccgattacggggtgtcttggatcagaca<br>gccaccggggaagggtctggaatggattggagtgatttggggctctgagactactt<br>actacaactcatccctcaagtcacgcgtcaccatctcaaaggacaactctaagaat<br>caggtgtcactgaaactgtcatctgtgaccgcagccgacaccgccgtgtactattg<br>cgctaagcattactattatggcgggagctacgcaatggattactggggacaggtga<br>ctctggtcaccgtgtccagcaccactacccagcaccgaggccacccaccccggct<br>cctaccatcgcctcccagcctctgtccctgcgtccggaggcatgtagacccgcagc<br>tggtggggccgtgcatacccgggtcttgacttcgcctgcgatatctacatttggg<br>cccctctggctggtacttgcggggtcctgctgctttcactcgtgatcactctttac<br>tgtaagcgcggtcggaagaagctgctgtacatctttaagcaacccttcatgaggcc<br>tgtgcagactactaagaggaggacggctgttcatgccggttcccagaggaggagg<br>aaggcggctgcgaactgcgcgtgaaattcagccgcagcgcagatgctccagcctac<br>aagcaggggcagaaccagctctacaacgaactcaatcttggtcggagagaggagta<br>cgacgtgctggacaagcggagaggacgggacccagaaatgggcggggaagccgcgca<br>gaaagaatccccaagagggcctgtacaacgagctccaaaaggataagatggcagaa<br>gcctatagcgagattggtatgaaggggaacgcagaagaggcaaaggccacgacgg<br>actgtaccagggactcagcaccgccaccaaggacacctatgacgctcttcacatgc<br>aggcccctgccgcctcgg |
| 105975<br>CAR 10<br>Full - aa | 40 | MALPVTALLLPLALLLHAARPEIVMTQSPATLSLSPGERATLSCRASQDISKYLNW<br>YQQKPGQAPRLLIYHTSRLHSGIPARFSGSGSGTDYTLTISSLQPEDFAVYFCQQG<br>NTLPYTFGQGTKLEIKGGGGSGGGGSGGGGSGGGGSQVQLQESGPGLVKPSETLSL<br>TCTVSGVSLPDYGVSWIRQPPGKGLEWIGVIWGSETTYYNSSLKSRVTISKDNSKN<br>QVSLKLSSVTAADTAVYYCAKHYYYGGSYAMDYWGQGTLVTVSSTTTPAPRPPTPA<br>PTIASQPLSLRPEACRPAAGGAVHTRGLDFACDIYIWAPLAGTCGVLLLSLVITLY<br>CKRGRKKLLYIFKQPFMRPVQTTQEEDGCSCRFPEEEEGGCELRVKFSRSADAPAY<br>KQGQNQLYNELNLGRREEYDVLDKRRGRDPEMGGKPRRKNPQEGLYNELQKDKMAE<br>AYSEIGMKGERRRGKGHDGLYQGLSTATKDTYDALHMQALPPR |

CAR11

| CAR11<br>scFv<br>domain | 11 | eivmtqspatlslspgeratlscrasqdiskylnwyqqkpgqaprlliyhtsrlhs<br>giparfsgsgsgtdytltisslqpedfavyfcqqgntlpytfgqgtkleikggggs<br>ggggsggggsqvqlqesgpglvkpsetlsltctvsgvslpdygvswirqppgkgle<br>wigviwgsettyynsslksrvtiskdnsknqvslklssvtaadtavyycakhyyyg<br>gsyamdywgqgtlvtvss |
| 103101<br>CAR11 -<br>Soluble<br>scFv - nt | 71 | Atggcctccctgtcaccgccctgctgttccgctggctcttctgctccacgccgc<br>tcggcccgaaattgtgatgacccagtcacccgccactcttagcctttcacccggtg<br>agcgcgcaacccgtcttgcagagcctcccaagacatctcaaaatacctaattgg<br>tatcaacagaagcccggacaggctcctcgccttctgatctaccacaccagccggct<br>ccattctggaatcctgccaggttcagcggtagcggatctgggacctacaccc<br>tcactatcagctcactgcagccagaggacttcgctgtctatttctgtcagcaaggg<br>aacaccctgccctacacctttggacagggcaccaagctcgagattaaaggtggagg<br>tggcagcggaggaggtgggtccggcggtggaggaagccaggtccaactccaagaaa<br>gcggaccgggtcttgtgaagccatcagaaactctttcactgacttgtactgtgga<br>ggagtgtctctccccgattacggggtgtcttggatcagacagccaccggggaaggg<br>tctggaatggattggagtgatttggggctctgagactacttactacaattcatccc<br>tcaagtcacgcgtcaccatctcaaaggacaactctaagaatcaggtgtcactgaaa<br>ctgtcatctgtgaccgcagccgacaccgccgtgtactattgcgctaagcattacta<br>ttatggcgggagctacgcaatggattactggggacagggtactctggtcaccgtgt<br>ccagccaccaccatcatcaccatcaccat |
| 103101<br>CAR11 -<br>Soluble<br>scFv - aa | 83 | MALPVTALLLPLALLLHAARPeivmtqspatlslspgeratlscrasqdiskylnw<br>yqqkpgqaprlliyhtsrlhsgiparfsgsgsgtdytltisslqpedfavyfcqqg<br>ntlpytfgqgtkleikggggsggggsggggsqvqlqesgpglvkpsetlsltctvs<br>gvslpdygvswirqppgkglewigviwgsettyynsslksrvtiskdnsknqvslk<br>lssvtaadtavyycakhyyyggsyamdywgqgtlvtvsshhhhhhhh |
| 105976<br>CAR 11<br>Full - nt | 95 | atggctctgcccgtgaccgcactcctcctgccactggctctgctgcttcacgccgc<br>tcgcccacaagtccagcttaagaatcaggccctggtctggtgaagccatctgaga<br>ctctgtccctcacttgcaccgtgagcggagtgtccctcccagactacggagtgagc<br>tggattagacagcctcccggaaagggactggagtggatcggagtgatttggggtag<br>cgaaaccacttactataactcttccctgaagtcacgggtcaccatttcaaaggata<br>actcaaagaatcaagtgagcctcaagctctcatcagtcaccgccgctgacaccgcc<br>gtgtattactgtgccaagcattactactatggagggtcctacgccatggactactg<br>gggccagggaactctggtcactgtgtcatctggtggaggaggtagcggaggaggcg<br>ggagcggtggaggtggctccggaggtggcgaagcgaaatcgtgatgacccagagc<br>cctgcaaccctgtcccttctcccggggaacgggctacccttttcttgtcgggcatc<br>acaagatatctcaaaatacctcaattggtatcaacagaagcccggacaggcccta<br>ggcttcttatctaccacacctctcgcctgcatagcgggattcccgcacgctttagc<br>gggtctggaagcgggaccgactacactctgaccatctcatctctccagcccgagga |

TABLE 2-continued

Humanized CD19 CAR Constructs

| Name | SEQ ID | Sequence |
|---|---|---|
| | | cttcgccgtctacttctgccagcagggtaacaccctgccgtacaccttcggccagg
gcaccaagcttgagatcaaaaccactactcccgctccaaggccacccacccctgcc
ccgaccatcgcctctcagccgctttccctgcgtccggaggcatgtagacccgcagc
tggtggggccgtgcatacccggggtcttgacttcgcctgcgatatctacatttggg
cccctctggctggtacttgcggggtcctgctgctttcactcgtgatcactctttac
tgtaagcgcggtcggaagaagctgctgtacatctttaagcaacccttcatgaggcc
tgtgcagactactcaagaggaggacggctgttcatgccggttcccagaggaggagg
aaggcggctgcgaactgcgcgtgaaattcagccgcagcgcagatgctccagcctac
aagcaggggcagaaccagctctacaacgaactcaatcttggtcggagagaggagta
cgacgtgctggacaagcggagaggacgggacccagaaatgggcgggaagccgcgca
gaaagaatccccaagagggcctgtacaacgagctccaaaaggataagatggcagaa
gcctatagcgagattggtatgaaaggggaacgcagaagaggcaaaggccacgacgg
actgtaccagggactcagcaccgccaccaaggacacctatgacgctcttcacatgc
aggccctgccgcctcgg |
| 105976 CAR 11 Full - aa | 41 | MALPVTALLLPLALLLHAARPQVQLQESGPGLVKPSETLSLTCTVSGVSLPDYGVS
WIRQPPGKGLEWIGVIWGSETTYYNSSLKSRVTISKDNSKNQVSLKLSSVTAADTA
VYYCAKHYYYGGSYAMDYWGQGTLVTVSSGGGGSGGGGSGGGGSGGGGSEIVMTQS
PATLSLSPGERATLSCRASQDISKYLNWYQQKPGQAPRLLIYHTSRLHSGIPARFS
GSGSGTDYTLTISSLQPEDFAVYFCQQGNTLPYTFGQGTKLEIKTTTPAPRPPTPA
PTIASQPLSLRPEACRPAAGGAVHTRGLDFACDIYIWAPLAGTCGVLLLSLVITLY
CKRGRKKLLYIFKQPFMRPVQTTQEEDGCSCRFPEEEEGGCELRVKFSRSADAPAY
KQGQNQLYNELNLGRREEYDVLDKRRGRDPEMGGKPRRKNPQEGLYNELQKDKMAE
AYSEIGMKGERRRGKGHDGLYQGLSTATKDTYDALHMQALPPR |

CAR12

| CAR12 scFv domain | 12 | qvqlqesgpglvkpsetlsltctvsgvslpdygvswirqppgkglewigviwgset
tyynsslksrvtiskdnsknqvslklssvtaadtavyycakhyyyggsyamdywgq
gtlvtvssggggsggggsggggseivmtqspatlslspgeratlscrasqdiskyl
nwyqqkpgqaprlliyhtsrlhsgiparfsgsgsgtdytltisslqpedfavyfcq
qgntlpytfgqgtkleik |
| 103104 CAR12 - Soluble scFv - nt | 72 | atggctctgccgtgaccgcactcctcctgccactggctctgctgcttcacgccgc
tcgccccacaagtccagcttcaagaatcagggcctggtctggtgaagccatctgaga
ctctgtccctcacttgcaccgtgagcggagtgtccctcccagactacggagtgagc
tggattagacagcctcccggaaagggactggagtggatcggagtgatttggggtag
cgaaaccacttactataactttccctgaagtcacgggtcaccatttcaaaggata
actcaaagaatcaagtgagcctcaagctctcatcagtcaccgccgctgacaccgcc
gtgtattactgtgccaagcattactactatggagggtcctacgccatggactactg
gggccagggaactctggtcactgtgtcatctggtggaggaggtagcggaggaggcg
ggagcggtggaggtggctccgaaatcgtgatgacccagagccctgcaacccctgtcc
cttttctcccggggaacgggctaccctttcttgtcgggcatcacaagatatctcaaa
atacctcaattggtatcaacagaagccgggacaggcccctaggcttcttatctacc
acacctctcgcctgcatagcgggattcccgcacgctttagcgggtctggaagcggg
accgactacactctgaccatctcatctctccagcccgaggacttcgccgtctactt
ctgccagcagggtaacaccctgccgtacaccttcggccagggcaccaagcttgaga
tcaaacatcaccaccatcatcaccatcac |
| 103104 CAR12 - Soluble scFv - aa | 84 | MALPVTALLLPLALLLHAARPqvqlqesgpglvkpsetlsltctvsgvslpdygvs
wirqppgkglewigviwgsettyynsslksrvtiskdnsknqvslklssvtaadta
vyycakhyyyggsyamdywgqgtlvtvssggggsggggsggggseivmtqspatls
lspgeratlscrasqdiskylnwyqqkpgqaprlliyhtsrlhsgiparfsgsgsg
tdytltisslqpedfavyfcqqgntlpytfgqgtkleikhhhhhhhh |
| 105977 CAR 12 - Full - nt | 96 | atggccctccctgtcaccgcctgctgcttccgctggctcttctgctccacgccgc
tcgccccgaaattgtgatgacccagtcaccgccactcttagcctttcacccggtg
agcgcgcaaccctgtcttgcagagcctcccaagacatctcaaatacccttaattgg
tatcaacagaagcccggacaggcctctcgcttctgatctaccacaccagccgct
ccattctggaatccctgccaggttcagcggtagcggatctggtgaccgactacaccc
tcactatcagctcactgcagccagaggacttcgctgtctatttctgtcagcaaggg
aacaccctgccctacacctttggacagggcaccaagctcgagattaaaggtggagg
tggcagcggagggaggtgggtccggcggtggaggaagccaggtccaactccaagaa
gcggacccgggtcttgtgaagccatcagaaactctttcactgacttgtactgtgagc
ggagtgtctctccccgattacgggtgtcttggatcagacagccaccggggaaggg
tctggaatggattggagtgatttggggctctgagactacttactacaactcatccc
tcaagtcacgcgtcaccatctcaaaggacaactctaagaatcaggtgtcactgaaa
ctgtcatctgtgaccgcagccgacaccgccgtgtactattgcgctaagcattacta
ttatggcgggagctacgcaatggattactgggacagggtactctggtcaccgtgt
ccagcaccactacccagcaccgaggccacccaccccggctcctaccatcgcctcc
cagcctctgtccctcgctcggaggcatgtagaccgcagctggtggggccgtgca
tacccgggtcttgacttcgcctgcgatatctacatttgggccctctggctggta
cttgcggggtcctgctgctttcactcgtgatcactcttttactgtaagcgcggtcgg
aagaagctgctgtacatctttaagcaacccttcatgaggcctgtgcagactactca
agaggaggacggctgttcatgccggttcccagaggaggaggaaggcggctgcgaac
tgcgcgtgaaattcagccgcagcgcagatgctccagcctacaagcaggggcagaac |

TABLE 2-continued

Humanized CD19 CAR Constructs

| Name | SEQ ID | Sequence |
|---|---|---|
| | | cagctctacaacgaactcaatcttggtcggagagaggagtacgacgtgctggacaa<br>gcggagaggacgggacccagaaatgggcgggaagccgcgcagaaagaatccccaag<br>agggcctgtacaacgagctccaaaaggataagatggcagaagcctatagcgagatt<br>ggtatgaaggggaacgcagaagaggcaaaggccacgacggactgtaccagggact<br>cagcaccgccaccaaggacacctatgacgctcttcacatgcaggccctgccgcctc<br>gg |
| 105977<br>CAR 12 -<br>Full - aa | 42 | MALPVTALLLPLALLLHAARPEIVMTQSPATLSLSPGERATLSCRASQDISKYLNW<br>YQQKPGQAPRLLIYHTSRLHSGIPARFSGSGSGTDYTLTISSLQPEDFAVYFCQQG<br>NTLPYTFGQGTKLEIKGGGGSGGGGSGGGGSQVQLQESGPGLVKPSETLSLTCTVS<br>GVSLPDYGVSWIRQPPGKGLEWIGVIWGSETTYYNSSLKSRVTISKDNSKNQVSLK<br>LSSVTAADTAVYYCAKHYYYGGSYAMDYWGQGTLVTVSSTTTPAPRPPTPAPTIAS<br>QPLSLRPEACRPAAGGAVHTRGLDFACDIYIWAPLAGTCGVLLLSLVITLYCKRGR<br>KKLLYIFKQPFMRPVQTTQEEDGCSCRFPEEEEGGCELRVKFSRSADAPAYKQGQN<br>QLYNELNLGRREEYDVLDKRRGRDPEMGGKPRRKNPQEGLYNELQKDKMAEAYSEI<br>GMKGERRRGKGHDGLYQGLSTATKDTYDALHMQALPPR |

TABLE 3

Murine CD19 CAR Constructs
CTL019

| CTL019-<br>Soluble<br>scFv-Histag -<br>nt | 97 | Atggccctgccgtcaccgctctgctgctgccccttgctctgcttcttcatgcagc<br>aaggccggacatccagatgacccaaaccacctcatccctctctgcctctcttggag<br>acagggtgaccattcttgtcgcgccagccaggacatcagcaagtatctgaactgg<br>tatcagcagaagccggacggaaccgtgaagctcctgatctaccatacctctcgcct<br>gcatagcggcgtgccctcacgcttctctggaagcggatcaggaaccgattattctc<br>tcactatttcaaatcttgagcaggaagatattgccacctatttctgccagcaggg<br>aatacccctgccctacaccttcggaggagggaccaagctcgaaatcaccggtggagg<br>aggcagcggcggtggagggtctggtggaggtggttctgaggtgaagctgcaagaat<br>caggccctggacttgtggccccttcacagtccctgagcgtgacttgcaccgtgtcc<br>ggagtctccctgcccgactacggagtgtcatggatcagacaacctccacggaaagg<br>actggaatggctccggtgtcatctggggtagcgaaactacttactacaattcagccc<br>tcaaaagcaggctgactattatcaaggacaacagcaagtcccaagtctttcttaag<br>atgaactcactccagactgacgacaccgcaatctactattgtgctaagcactacta<br>ctacggaggatcctacgctatggattactggggacaaggtacttccgtcactgtct<br>cttcacaccatcatcaccatcaccatcac |
| --- | --- | --- |
| CTL019-<br>Soluble<br>scFv-Histag -<br>aa | 98 | MALPVTALLLPLALLLHAARPdiqmtqttsslsaslgdrvtiscrasqdiskylnw<br>yqqkpdgtvklliyhtsrlhsgvpsrfsgsgsgtdysltisnleqediatyfcqqg<br>ntlpytfgggtkleitggggsggggsggggsevklqesgpglvapsqslsvtctvs<br>gvslpdygvswirqpprkglewlgviwgsettyynsalksrltiikdnsksqvflk<br>mnslqtddtaiyycakhyyyggsyamdywgqgtsvtvsshhhhhhhh |
| CTL019<br>Full - nt | 99 | atggccttaccagtgaccgccttgctcctgccgctggccttgctgctccacgccgc<br>caggccggacatccagatgacacagactacatcctccctgtctgcctctctgggag<br>acagagtcaccatcagttgcagggcaagtcaggacattagtaaatatttaaattgg<br>tatcagcagaaaccagatggaactgttaaactcctgatctaccatacatcaagatt<br>acactcaggagtcccatcaaggttcagtggcagtgggtctggaacagattattctc<br>tcaccattagcaacctggagcaagaagatattgccacttacttttgccaacaggt<br>aatacgcttccgtacacgttcggaggggggaccaagctggagatcacaggtggcgg<br>tggctcggcggtggtgggtcggtggcggcggatctgaggtgaaactgcaggagt<br>caggacctggcctggtggcgcctcacagagcctgtccgtcacatgcactgtctca<br>gggtctcattaccgactatggtgtaagctggattcgccagcctccacgaaaggg<br>tctggagtggctgggagtaatatggggtagtgaaaccacatactataattcagctc<br>tcaaatccagactgaccatcatcaaggacaactccaagagccaagttttcttaaaa<br>atgaacagtctgcaaactgatgacacagccatttactactgtgccaaacattatta<br>ctacggtggtagctatgctatggactactggggccaaggaacctcagtcaccgtct<br>cctcaaccacgacgccagcgccgcgaccaccaacaccggcgcccaccatcgcgtcg<br>cagccctgtccctgcgcccagaggcgtgccggccagcggcggggggcgcagtgca<br>cacgagggggctggacttcgcctgtgatatctacatctgggcgcccttggccggga<br>cttgtggggtccttctcctgtcactggttatcaccctttactgcaaacggggcaga<br>aagaaactcctgtatatattcaaacaaccatttatgagacagtacaaactactca<br>agaggaagatggctgtagctgccgatttccagaagaagaagaaggaggatgtgaac<br>tgagagtgaagttcagcaggagcgcagacgcccccgcgtacaagcagggccagaac<br>cagctctataacgagctcaatctaggacgaagagaggagtacgatgttttggacaa<br>gacgtggccgggacccctgatggggggaaagccgagaaggaagaaccctcagg<br>aaggcctgtacaatgaactgcagaaagataagatggcggaggcctacagtgagatt<br>gggatgaaaggcgagcgccggaggggcaaggggcacgatggcctttaccagggtct<br>cagtacagccaccaaggacacctacgacgcccttcacatgcaggccctgccccctc<br>gc |

TABLE 3-continued

Murine CD19 CAR Constructs
CTL019

| CTL019 Full - aa | 58 | MALPVTALLLPLALLLHAARPdiqmtqttsslsaslgdrvtiscrasqdiskylnw yqqkpdgtvklliyhtsrlhsgvpsrfsgsgsgtdysltisnleqediatyfcqqg ntlpytfgggtkleitggggsggggsggggsevklqesgpglvapsqslsvtctvs gvslpdygvswirqpprkglewlgviwgsettyynsalksrltiikdnsksqvflk mnslqtddtaiyycakhyyyggsyamdywgqgtsvtvssttpaprpptpaptias qplslrpeacrpaaggavhtrgldfacdiyiwaplagtcgvlllslvitlyckrgr kkllyifkqpfmrpvqttqeedgcscrfpeeeeggcelrvkfsrsadapaykqggn qlynelnlgrreeydvldkrrgrdpemggkprrknpqeglynelqkdkmaeaysei gmkgerrrgkhdglyqglstatkdtydalhmqalppr |
|---|---|---|
| CTL019 scFv domain | 59 | Diqmtqttsslsaslgdrvtiscrasqdiskylnwyqqkpdgtvklliyhtsrlhs gvpsrfsgsgsgtdysltisnleqediatyfcqqgntlpytfgggtkleitggggs ggggsggggsevklqesgpglvapsqslsvtctvsgvslpdygvswirqpprkgle wlgviwgsettyynsalksrltiikdnsksqvflkmnslqtddtaiyycakhyyyg gsyamdywgqgtsvtvss |
| mCAR1 scFv | 109 | QVQLLESGAELVRPGSSVKISCKASGYAFSSYWMNWVKQRPGQGLEWIGQIYPGDG DTNYNGKFKGQATLTADKSSSTAYMQLSGLTSEDSAVYSCARKTISSVVDFYFDYW GQGTTVTGGGSGGGSGGGSGGGSELVLTQSPKFMSTSVGDRVSVTCKASQNVGTNV AWYQQKPGQSPKPLIYSATYRNSGVPDRFTGSGSGTDFTLTITNVQSKDLADYFCQ YNRYPYTSFFFTKLEIKRRS |
| mCAR1 Full - aa | 110 | QVQLLESGAELVRPGSSVKISCKASGYAFSSYWMNWVKQRPGQGLEWIGQIYPGDG DTNYNGKFKGQATLTADKSSSTAYMQLSGLTSEDSAVYSCARKTISSVVDFYFDYW GQGTTVTGGGSGGGSGGGSGGGSELVLTQSPKFMSTSVGDRVSVTCKASQNVGTNV AWYQQKPGQSPKPLIYSATYRNSGVPDRFTGSGSGTDFTLTITNVQSKDLADYFCQ YNRYPYTSFFFTKLEIKRRSKIEVMYPPPYLDNEKSNGTIIHVKGKHLCPSPLFPG PSKPFWVLVVVGGVLACYSLLVTVAFTIFWVRSKRSRLLHSDYMNMTPRRPGPTRK HYQPYAPPRDFAAYRSRVKFSRSADAPAYQQGQNQLYNELNLGRREEYDVLDKRRG RDPEMGGKPRRKNPQEGLYNELQKDKMAEAYSEIGMKGERRRGKHDGLYQGLSTA TKDTYDALHMQALPPR |
| mCAR2 scFv | 111 | DIQMTQTTSSLSASLGDRVTISCRASQDISKYLNWYQQKPDGTVKLLIYHTSRLHS GVPSRFSGSGSGTDYSLTISNLEQEDIATYFCQQGNTLPYTFGGGTKLEITGSTSG SGKPGSGEGSTKGEVKLQESGPGLVAPSQSLSVTCTVSGVSLPDYGVSWIRQPPRK GLEWLGVIWGSETTYYNSALKSRLTIIKDNSKSQVFLKMNSLQTDDTAIYYCAKHY YYGGSYAMDYWGQGTSVTVSSE |
| mCAR2 CAR - aa | 112 | DIQMTQTTSSLSASLGDRVTISCRASQDISKYLNWYQQKPDGTVKLLIYHTSRLHS GVPSRFSGSGSGTDYSLTISNLEQEDIATYFCQQGNTLPYTFGGGTKLEITGSTSG SGKPGSGEGSTKGEVKLQESGPGLVAPSQSLSVTCTVSGVSLPDYGVSWIRQPPRK GLEWLGVIWGSETTYYNSALKSRLTIIKDNSKSQVFLKMNSLQTDDTAIY YCAKHYYYGGSYAMDYWGQGTSVTVSSESKYGPPCPPCPMFWVLVVVGGVLACYSL LVTVAFIIFWVKRGRKKLLYIFKQPFMRPVQTTQEEDGCSCRFEEEEGGCELRVKF SRSADAPAYQQGQNQLYNELNLGRREEYDVLDKRRGRDPEMGGKPRRKNPQEGLYN ELQKDKMAEAYSEIGMKGERRRGKHDGLYQGLSTATKDTYDALHMQALPPRL |
| mCAR2 Full - aa | 113 | DIQMTQTT SSLSASLGDR VTISCRASQD ISKYLNWYQQ KPDGTVKLLI YHTSRLHSGV PSRFSGSGSG TDYSLTISNL EQEDIATYFC QQGNTLPYTF GGGTKLEITG STSGSGKPGS GEGSTKGEVK LQESGPGLVA PSQSLSVTCT VSGVSLPDYG VSWIRQPPRK GLEWLGVIWG SETTYYNSAL KSRLTIIKDN SKSQVFLKMN SLQTDDTAIY YCAKHYYYGG SYAMDYWGQG TSVTVSSESK YGPPCPPCPM FWVLVVVGGV LACYSLLVTV AFIIFWVKRG RKKLLYIFKQ PFMRPVQTTQ EEDGCSCRFE EEEGGCELRV KFSRSADAPA YQQGQNQLYN ELNLGRREEY DVLDKRRGRD PEMGGKPRRK NPQEGLYNEL QKDKMAEAYS EIGMKGERRR GKHDGLYQG LSTATKDTYD ALHMQALPPR LEGGGEGRGS LLTCGDVEEN PGPRMLLLVT SLLLCELPHP AFLLIPRKVC NGIGIGEFKD SLSINATNIK HFKNCTSISG DLHILPVAFR GDSFTHTPPL DPQELDILKT VKEITGFLLI QAWPENRTDL HAFENLEIIR GRTKQHGQFS LAVVSLNITS LGLRSLKEIS DGDVIISGNK NLCYANTINW KKLFGTSGQK TKIISNRGEN SCKATGQVCH ALCSPEGCWG PEPRDCVSCR NVSRGRECVD KCNLLEGEPR EFVENSECIQ CHPECLPQAM NITCTGRGPD NCIQCAHYID GPHCVKTCPA GVMGENNTLV WKYADAGHVC HLCHPNCTYG CTGPGLEGCP TNGPKIPSIA TGMVGALLLL LVVALGIGLF M |
| mCAR3 scFv | 114 | DIQMTQTTSSLSASLGDRVTISCRASQDISKYLNWYQQKPDGTVKLLIYHTSRLHS GVPSRFSGSGSGTDYSLTISNLEQEDIATYFCQQGNTLPYTFGGGTKLEITGSTSG SGKPGSGEGSTKGEVKLQESGPGLVAPSQSLSVTCTVSGVSLPDYGVSWIRQPPRK GLEWLGVIWGSETTYYNSALKSRLTIIKDNSKSQVFLKMNSLQTDDTAIYYCAKHY YGGSYAMDYWGQGTSVTVSS |
| mCAR3 Full - aa | 115 | DIQMTQTTSSLSASLGDRVTISCRASQDISKYLNWYQQKPDGTVKLLIYHTSRLHS GVPSRFSGSGSGTDYSLTISNLEQEDIATYFCQQGNTLPYTFGGGTKLEITGSTSG |

TABLE 3-continued

Murine CD19 CAR Constructs
CTL019

```
SGKPGSGEGSTKGEVKLQESGPGLVAPSQSLSVTCTVSGVSLPDYGVSWIRQPPRK
GLEWLGVIWGSETTYYNSALKSRLTIIKDNSKSQVFLKMNSLQTDDTAIYYCAKHY
YYGGSYAMDYWGQGTSVTVSSAAAIEVMYPPPYLDNEKSNGTIIHVKGKHLCPSPL
FPGPSKPFWVLVVVGGVLACYSLLVTVAFIIFWVRSKRSRLLHSDYMNMTPRRPGP
TRKHYQPYAPPRDFAAYRSRVKFSRSADAPAYQQGQNQLYNELNLGRREEYDVLDK
RRGRDPEMGGKPRRKNPQEGLYNELQKDKMAEAYSEIGMKGERRRGKGHDGLYQGL
STATKDTYDALHMQALPPR
```

In some embodiments, the antigen binding domain comprises a HC CDR1, a HC CDR2, and a HC CDR3 of any heavy chain binding domain amino acid sequences listed in Table 2. In embodiments, the antigen binding domain further comprises a LC CDR1, a LC CDR2, and a LC CDR3. In embodiments, the antigen binding domain comprises a LC CDR1, a LC CDR2, and a LC CDR3 of any light chain binding domain amino acid sequences listed in Table 2.

In some embodiments, the antigen binding domain comprises one, two or all of LC CDR1, LC CDR2, and LC CDR3 of any light chain binding domain amino acid sequences listed in Table 2, and one, two or all of HC CDR1, HC CDR2, and HC CDR3 of any heavy chain binding domain amino acid sequences listed in Table 2.

In some embodiments, the CDRs are defined according to the Kabat numbering scheme, the Chothia numbering scheme, or a combination thereof.

The sequences of humanized CDR sequences of the scFv domains are shown in Table 4 for the heavy chain variable domains and in Table 5 for the light chain variable domains. "ID" stands for the respective SEQ ID NO for each CDR.

EF1 alpha promoter (SEQ ID NO: 100)
```
CGTGAGGCTCCGGTGCCCGTCAGTGGGCAGAGCGCACATCGCCCACAGTC

CCCGAGAAGTTGGGGGGAGGGGTCGGCAATTGAACCGGTGCCTAGAGAAG

GTGGCGCGGGGTAAACTGGGAAAGTGATGTCGTGTACTGGCTCCGCCTTT

TTCCCGAGGGTGGGGAGAACCGTATATAAGTGCAGTAGTCGCCGTGAAC

GTTCTTTTTCGCAACGGGTTTGCCGCCAGAACACAGGTAAGTGCCGTGTG

TGGTTCCCGCGGGCCTGGCCTCTTTACGGGTTATGGCCCTTGCGTGCCTT

GAATTACTTCCACCTGGCTGCAGTACGTGATTCTTGATCCCGAGCTTCGG

GTTGGAAGTGGGTGGGAGAGTTCGAGGCCTTGCGCTTAAGGAGCCCCTTC

GCCTCGTGCTTGAGTTGAGGCCTGGCCTGGGCGCTGGGGCCGCCGCGTGC

GAATCTGGTGGCACCTTCGCGCCTGTCTCGCTGCTTTCGATAAGTCTCTA

GCCATTTAAAATTTTTGATGACCTGCTGCGACGCTTTTTTTCTGGCAAGA
```

TABLE 4

Heavy Chain Variable Domain CDRs (Kabat)

| Candidate | FW | HCDR1 | ID | HCDR2 | ID | HCDR3 | ID |
|---|---|---|---|---|---|---|---|
| murine_CART19 | | GVSLPDYGVS | 19 | VIWGSETTYYNSALKS | 20 | HYYYGGSYAMDY | 24 |
| humanized_CART19 a | VH4 | GVSLPDYGVS | 19 | VIWGSETTYYSSSLKS | 21 | HYYYGGSYAMDY | 24 |
| humanized_CART19 b | VH4 | GVSLPDYGVS | 19 | VIWGSETTYYQSSLKS | 22 | HYYYGGSYAMDY | 24 |
| humanized_CART19 c | VH4 | GVSLPDYGVS | 19 | VIWGSETTYYNSSLKS | 23 | HYYYGGSYAMDY | 24 |

TABLE 5

Light Chain Variable Domain CDRs

| Candidate | FW | LCDR1 | ID | LCDR2 | ID | LCDR3 | ID |
|---|---|---|---|---|---|---|---|
| murine_CART19 | | RASQDISKYLN | 25 | HTSRLHS | 26 | QQGNTLPYT | 27 |
| humanized_CART19 a | VK3 | RASQDISKYLN | 25 | HTSRLHS | 26 | QQGNTLPYT | 27 |
| humanized_CART19 b | VK3 | RASQDISKYLN | 25 | HTSRLHS | 26 | QQGNTLPYT | 27 |
| humanized_CART19 c | VK3 | RASQDISKYLN | 25 | HTSRLHS | 26 | QQGNTLPYT | 27 |

The CAR scFv fragments were then cloned into lentiviral vectors to create a full length CAR construct in a single coding frame, and using the EF1 alpha promoter for expression (SEQ ID NO: 100).

-continued
```
TAGTCTTGTAAATGCGGGCCAAGATCTGCACACTGGTATTTCGGTTTTTG

GGGCCGCGGGCGGCGACGGGGCCCGTGCGTCCCAGCGCACATGTTCGGCG
```

```
AGGCGGGGCCTGCGAGCGCGGCCACCGAGAATCGGACGGGGGTAGTCTCA

AGCTGGCCGGCCTGCTCTGGTGCCTGGCCTCGCGCCGCCGTGTATCGCCC

CGCCCTGGGCGGCAAGGCTGGCCCGGTCGGCACCAGTTGCGTGAGCGGAA

AGATGGCCGCTTCCCGGCCCTGCTGCAGGGAGCTCAAAATGGAGGACGCG

GCGCTCGGGAGAGCGGGCGGGTGAGTCACCCACACAAAGGAAAAGGGCCT

TTCCGTCCTCAGCCGTCGCTTCATGTGACTCCACGGAGTACCGGCGCCG

TCCAGGCACCTCGATTAGTTCTCGAGCTTTTGGAGTACGTCGTCTTTAGG

TTGGGGGGAGGGGTTTTATGCGATGGAGTTTCCCCACACTGAGTGGGTGG

AGACTGAAGTTAGGCCAGCTTGGCACTTGATGTAATTCTCCTTGGAATTT

GCCCTTTTTGAGTTTGGATCTTGGTTCATTCTCAAGCCTCAGACAGTGGT

TCAAAGTTTTTTTCTTCCATTTCAGGTGTCGTGA.
```

5 CAR22 Constructs: Design and Function

Fully human anti-CD22 single chain variable fragments were isolated. Anti-CD22 ScFvs were cloned into lentiviral CAR expression vectors with the CD3zeta chain and the 4-1BB costimulatory molecule. CAR-containing plasmids were amplified by bacterial transformation in STBL3 cells, followed by Maxiprep using endotoxin-free Qiagen Plasmid Maki kit. Lentiviral supernatant was produced in 293T cells using standard techniques.

The sequences of the human CARs are provided below in Table 6A and 6B.

These clones all contained a Q/K residue change in the signal domain of the co-stimulatory domain derived from CD3zeta chain.

TABLE 6A

Human CD22 CAR Constructs

| Name | SEQ ID | Sequence |
|------|--------|----------|
| m971 NT | 200 | gtgcacgagtgggttacatcgaactggatctcaacagcggtaagatccttgagagttttcgcccg<br>aagaacgttttccaatgatgagcacttttaaagttctgctatgtggcgcggtattatcccgtattg<br>acgccgggcaagagcaactcggtcgccgcatacactattctcagaatgacttggttgagtactcac<br>cagtcacagaaaagcatcttacggatggcatgacagtaagagaattatgcagtgctgccataacca<br>tgagtgataacactgcggccaacttacttctgacaacgatcggaggaccgaaggagctaaccgctt<br>ttttgcacaacatgggggatcatgtaactcgccttgatcgttgggaaccggagctgaatgaagcca<br>taccaaacgacgagcgtgacaccacgatgcctgtagcaatggcaacaacgttgcgcaaactattaa<br>ctggcgaactacttactctagcttcccggcaacaattaatagactggatggaggcggataaagttg<br>caggaccacttctgcgctcggccttccggctggctggttattgctgataaatctggagccggtg<br>agcgtgggtctcgcggtatcattgcagcactggggccagatggtaagccctcccgtatcgtagtta<br>tctacacgacggggagtcaggcaactatggatgaacgaaatagacagatcgctgagataggtgcct<br>cactgattaagcattggtaactgtcagaccaagtttactcatatatactttagattgatttaaaac<br>ttcattttaatttaaaaggatctaggtgaagatccttttgataatctcatgaccaaaatcccctt<br>aacgtgagttttcgttccactgagcgtcagacccgtagaaaagatcaaaggatcttcttgagatc<br>cttttttctgcgcgtaatctgctgcttgcaaacaaaaaaaccaccgctaccagcggtggtttgtt<br>tgccggatcaagagctaccaactctttttccgaaggtaactggcttcagcagagcgcagataccaa<br>atactgttcttctagtgtagccgtagttaggccaccacttcaagaactctgtagcaccgcctacat<br>acctcgctctgctaatcctgttaccagtggctgctgccagtggcgataagtcgtgtcttaccgggt<br>tggactcaagacgatagttaccggataaggcgcagcggtcgggctgaacgggggttcgtgcacac<br>agcccagcttggagcgaacgacctacaccgaactgagatacctacagcgtgagctatgagaaagcg<br>ccacgcttcccgaaggggagaaaggcggacaggtatccggtaagcggcagggtcggaacaggagagc<br>gcacgagggagctccagggggaaacgcctggtatctttatagtcctgtcgggtttcgccacctct<br>gacttgagcgtcgattttgtgatgctcgtcagggggcggagcctatggaaaaacgccagcaacg<br>cggccttttacggttcctggccttttgctggccttttgctcacatgttcttcctgcgttatccc<br>ctgattctgtggataaccgtattaccgcctttgagtgagctgataccgctcgccgcagccgaacga<br>ccgagcgcagcgagtcagtgagcgaggaagcggaagagcgcccaatacgcaaaccgcctctcccg<br>cgcgttggccgattcattaatgcagctggcacgacaggtttcccgactggaaagcgggcagtgagc<br>gcaacgcaattaatgtgagttagctcactcattaggcaccccaggctttacactttatgcttccgg<br>ctcgtatgttgtgtggaattgtgagcggataacaatttcacacaggaaacagctatgaccatgatt<br>acgccaagcgcgcaattaaccctcactaaagggaacaaaagctggagctgcaagcttaatgtagtc<br>ttatgcaatactcttgtagtcttgcaacatggtaacgatgagttagcaacatgccttacaaggaga<br>gaaaaagcaccgtgcatgccgattggtggaagtaaggtggtacgatcgtgccttattaggaaggca<br>acagacgggtctgacatggattggacgaaccactgaattgccgcattcagagatattgtatttaa<br>gtgcctagctcgatacataaacgggtctctctggttagaccagatctgagcctgggagctctctgg<br>ctaactagggaacccactgcttaagcctcaataaagcttgccttgagtgcttcaagtagtgtgtgc<br>ccgtctgttgtgtgactctggtaactagagatccctcagacccttttagtcagtgtggaaaatctc<br>tagcagtggcgcccgaacagggacttgaaagcgaaagggaaaccagaggagctctctcgacgcagg<br>actcggcttgctgaagcgcgcacggcaagaggcgaggggcggcgactggtgagtacgccaaaaatt<br>ttgactagcggaggctagaaggagagagatgggtgcgagagcgtcagtattaagcggggggagaatt<br>agatcgcgatgggaaaaaattcggttaaggccaggggggaaagaaaaaatataaaattaaaacatata<br>gtatgggcaagcagggagctagaacgattcgcagttaatcctggcctgttagaaacatcagaaggc<br>tgtagacaaatactgggacagctacaaccatccttcagacaggatcagaagaacttagatcatta<br>tataataacagtagcaaccctctattgtgtgcatcaaaggatagagataaaagacaccaaggaagct<br>tagacaagatagaggaagagcaaaacaaaagtaagaccaccgcacagcaagcggccgctgatctt<br>cagacctggaggaggagatatgagggacaattggagaagtgaattatataaatataaagtagtaaa<br>aattgaaccattaggagtagcacccaccaaggcaaagaagagtggtgcagagagaaaaagagc<br>agtgggaataggagctttgttccttgggttcttgggagcagcaggaagcactatgggcgcagcgtc<br>aatgacgctgacggtacaggccagacaattattgtctggtatagtgcagcagcagaacaatttgct<br>gagggctattgaggcgcaacagcatctgttgcaactcacagtctggggcatcaagcagctccaggc<br>aagaatcctggctgtggaaagatacctaaaggatcaacagctcctggggatttggggttgctctgg<br>aaaactcatttgcaccactgctgtgccttggaatgctagttggagtaataaatctctggaacagat<br>ttggaatcacacgacctggatggagtgggacagagaaattaacaattcacacaagcttaatacactc<br>cttaattgaagaatcgcaaaaccagcaagaaaagaatgaacaagaattattggaattagataaatg |

TABLE 6A-continued

Human CD22 CAR Constructs

| Name | SEQ ID | Sequence |
|---|---|---|

```
ggcaagtttgtggaattggtttaacataacaaattggctgtggtatataaaattattcataatgat
agtaggaggcttggtaggtttaagaatagttttttgctgtactttctatagtgaatagagttaggca
gggatattcaccattatcgtttcagacccacctcccaaccccgaggggacccgacaggcccgaagg
aatagaagaagaaggtggagagagagacagagacagatccattcgattagtgaacggatctcgacg
gtatcgattagactgtagcccaggaatatggcagctagattgtacacatttagaaggaaaagttat
cttggtagcagttcatgtagccagtggatatatagaagcagaagtaattccagcagagacagggca
agaaacagcatacttcctcttaaaattagcaggaagatggccagtaaaaacagtacatacagacaa
tggcagcaatttcaccagtactacagttaaggccgcctgttggtgggcgggatcaagcaggaatt
tggcattccctacaatccccaaagtcaaggagtaatagaatctatgaataaagaattaaagaaaat
tataggacaggtaagagatcaggctgaacatcttaagacagcagtacaaatggcagtattcatcca
caattttaaaagaaaaggggggattggggggtacagtgcagggggaaagaatagtagacataatag
caacagacatacaaactaaagaattacaaaaacaaattacaaaaattcaaaattttcgggtttatt
acagggacagcagagatccagtttggctgcatacgcgtcgtgggctccggtgcccgtcagtgggc
agagcgcacatcgcccacagtccccgagaagttgggggagggtcggcaattgaaccggtgccta
gagaaggtggcgcggggtaaactgggaaagtgatgtcgtgtactggctccgcttttttcccgaggg
tggggagaaccgtatataagtgcagtagtcgccgtgaacgttcttttttcgcaacgggtttgccgc
cagaacacaggtaagtgccgtgtgtggttcccgcgggcctggcctcttttacgggttatggcccttg
cgtgccttgaattacttccacctggctgcagtacgtcgattcttgatcccgagcttcgggttggaag
tgggtgggagagttcgaggccttgcgcttaaggagccccttcgcctcgtgcttgagttgaggcctg
gcctgggcgctggggccgccgcgtgcgaatctggtggcaccttcgcgcctgtctcgctgctttcga
taagtctctagccatttaaaattttttgatgacctgctgcgacgctttttttctggcaagatagtct
tgtaaatgcgggccaagatctgcacactggtatttcggtttttgggggccgcgggcggcgacgggc
ccgtgcgcccagcgcacatgttcggcgaggcggggcctgcgagcgcggccaccgagaatcggacg
ggggtagtctcaagctggccggcctgctctggtgcctggcctcgcgccgccgtgtatcgccccgcc
ctgggcggcaaggctggcccggtcggcaccagttgcgtgagcggaaagatggccgcttcccggcc
tgctgcaggagctcaaaatggaggacgggcgctcgggaagcagggggcgggtgagtcacccacaca
aaggaaaagggcctttccgtcctcagccgtcgcttcatgtgactccactgagtaccgggcgccgtc
caggcacctcgattagttctcgtgcttttggagtacgtcgtctttaggttgggggagggtttta
tgcgatggagtttccccacactgagtgggtggagactgaagttaggccagcttggcacttgatgta
attctccttggaatttgcccttttgagtttggttcattctcaagcctcagacagtggt
tcaaagttttttttcttccatttcaggtgtcgtgagctagctctagagccaccatggccctgcctgt
gacagccctgctgctgcctctggctctgctgctgcatgccgctagacccggatcccaggtgcagct
gcagcagtctggacccggcctcgtgaagcctagccagaccctgtctctgacctgcgccatcagcgg
cgatagcgtgtccagcaatagcgccgcctggaactggatcagacagagccctagcagaggcctgga
atggctgggccggacctactaccggtccaagtggtacaacgactacgccgtgtccgtgaagtcccg
gatcaccatcaaccccgacaccagcaagaaccagttctccctgcagctgaacagcgtgacccccga
ggataccgccgtgtactactgcgccagagaagtgaccggcgacctggaagatgccttcgacatctg
gggccagggcacaatggtcaccgtctcagcggaggcggaggatctggcggcggaggaagtggcgg
aggggatctggggaggcggaagcgatatccagatgacccagagcccagctccctgtctgccag
cgtgggcgacagagtgaccatcacctgtagggccagccagaccatctggtcctacctgaactggta
tcagcagcggcctggcaaggcccccaacctgctgatctatgccgccagctctctgcagtccggcgt
gcccagcagattttccggcagaggctccggcaccgacttcaccctgacaatcagttccctgcaggc
cgaggacttcgccacctactactgccagcagagctacagcatccccagaccttcggcggggac
caagctggaaatcaagtccggaaccacgacgccagcgccgcgaccaccaacaccggcgcccaccat
cgcgtcgcagcccctgtccctgcgcccagaggcgtgccggccagcggcggggggcgcagtgcacac
gaggggctggacttcgcctgtgatatctacatctgggcccttggccgggacttgtgggtcct
tctcctgtcactggttatcacccttttactgcaaacggggcagaaagaaactcctgtatatattcaa
acaaccatttatgagaccagtacaaactactcaagaggaagatggctgtagctgccgatttccaga
agaagaaggaggatgtgaactgagagtgaagttcagcaggagcgcagacgccccgcgtacaa
gcagggccagaaccagctctataacgagctcaatctaggacgaagagaggagtacgatgttttgga
caagacgtggccgggaccctgagatgggggaaagccgagaaggaagaaccctcaggaaggcct
gtacaatgaactgcagaaagataagatggcggaggccacagtgagattgggatgaaaggcgagcg
ccggaggggcaaggggcacgatggcctttaccagggtctcagtacagccaccaaggacacctacga
cgcccttcacatgcaggccctgccccctcgctaagtcgacaatcaacctctggattacaaaatttg
tgaaagattgactggtattcttaactatgttgctccttttacgctatgtggatacgctgcttaat
gcctttgtatcatgctattgcttcccgtatggctttcattttctcctccttgtataaatcctggtt
gctgtctctttatgaggagttgtggcccgttgtcaggcaacgtggcgtggtgtgcactgtgtttgc
tgacgcaaccccactggttggggcattgccaccacctgtcagctcctttccgggactttcgcttt
ccccctccctattgccacggcggaactcatcgccgcctgccttgcccgctgctggacaggggctcg
gctgttgggcactgacaattccgtggtgttgtcggggaagctgacgtcctttccatggctgctcgc
ctgtgttgccacctggattctgcgcgggacgtcctttctgctacgtcccttcggccctcaatccagc
ggaccttccttcccgcggcctgctgccggctctgcggcctcttccgcgtcttcgccttcgccctca
gacgagtcggatctccctttaagccgcctccccgcctggaattcgagctcggtaccttaagacca
atgacttacaaggcagctgtagatcttagccacttttaaaagaaaaggggggactggaagggcta
attcactcccaacgaagacaagatctgctttttgcttgtactgggtctctctggttagaccagatc
tgagcctgggagctctctggctaactagggaacccactgcttaagcctcaataaagcttgccttga
gtgcttcaagtagtgtgtgcccgtctgttgtgtgactctggtaactagagatccctcagacccttt
tagtcagtgtggaaaatctctagcagtagtagttcatgtcatcttattattcagtatttataactt
gcaaagaaatgaatatcagagagtgagaggaacttgtttattgcagcttataatggttacaaataa
agcaatagcatcacaaatttcacaaataaagcattttttcactgcattctagttgtggtttgtcc
aaactcatcaatgtatcttatcatgtctgctagccatccgccccaactccgccccagttccg
cccattctccgccccatgctgactaattttttttatttatgcagaggccgaggccgcctcggcct
ctgagctattccagaagtagtgaggaggcttttttggaggcctaggcttttgcgtcgagacgtacc
caattcgccctatagtgagtcgtattacgcgcgctcactggccgtcgttttacaacgtcgtgactg
ggaaaaccctggcgttacccaacttaatcgccttgcagcacatccccctttcgccagctggcgtaa
tagcgaagaggcccgcaccgatcgcccttcccaacagttgcgcagcctgaatggcgaatgggacgc
```

TABLE 6A-continued

Human CD22 CAR Constructs

| Name | SEQ ID | Sequence |
|---|---|---|
| | | gccctgtagcggcgcattaagcgcggcgggtgtggtggttacgcgcagcgtgaccgctacacttgc<br>cagcgccctagcgcccgctcctttcgctttcttcccttcctttctcgccacgttcgccggctttcc<br>ccgtcaagctctaaatcggggctccctttagggttccgatttagtgctttacggcacctcgaccc<br>caaaaaacttgattagggtgatggttcacgtagtgggccatcgccctgatagacggtttttcgccc<br>tttgacgttggagtccacgttctttaatagtggactcttgttccaaactggaacaacactcaaccc<br>tatccggtctattcttttgatttataagggattttgccgatttcggcctattggttaaaaaatga<br>gctgatttaacaaaaatttaacgcgaattttaacaaaatattaacgcttacaatttaggtggcact<br>tttcggggaaatgtgcgcggaacccctatttgtttatttttctaaatacattcaaatatgtatccg<br>ctcatgagacaataaccctgataaatgcttcaataatattgaaaaaggaagagtatgagtattcaa<br>catttccgtgtcgcccttattccctttttgcggcattttgccttcctgttttttgctcacccagaa<br>acgctggtgaaagtaaaagatgctgaagatcagttgg |
| m971 VH | 201 | qvqlqqsgpg lvkpsqtlsl tcaisgdsvs snsaawnwir qspsrglewl grtyyrskwy<br>ndyavsvksr itinpdtskn qfslqlnsvt pedtavyyca revtgdleda fdiwgqgtmv<br>tvssastkgp svfplapssk stsggtaalg clvkdyfpep vtvswnsgal tsgvhtfpav<br>lqssglysls svvtvpsssl gtqtyicnvs hkpsntkvdk kvepkscdkt sgqag |
| m971 VL | 202 | diqmtqspss lsasvgdrvt itcrasqtiw sylnwyqqrp gkapnlliya asslqsgvps<br>rfsgrgsgtd ftltisslqa edfatyycqq sysipqtfgq gtkleikrtv aapsvfifpp<br>sdeqlksgta svvcllnnfy preakvqwkv dnalqsgnsq esvteqdskd styslssstlt<br>lskadyekhk vyacevthqg lsspvtksfn rgec |
| CAR22-1 scFv AA | 203 | qvqlvqsgggliqpggslrlscaasgftvssnymswvrqapgkglewvsviysggstyyadsvkgr<br>ftisrdnskntlylqmnslraedtavyycasqstpydssgyysgdafdiwgqgtmvtvssggggsg<br>gggsggggssyvltqppsasgtpgqrvtiscsgsssnigsnyvywyqqlpgtapklliyrnnqrps<br>gvpdrfsgsksgtsaslaisglrsedeadyycaawddslsgyvfgtgtkltvl |
| CAR22-1 scFv NT | 204 | caagtgcaactcgtccaatccggcggcggactgattcaaccaggaggttcccttagactctcatgt<br>gccgctagcggattcactgtgtcctcaaactacatgagctgggtccgccaggcgcccggaaagggc<br>ctggaatgggtgtccgtgatctactcgggcggatcaacctactacgccgattccgtgaagggccgg<br>ttcaccatctcgcgggataactccaagaacaccctgtacttgcaaatgaactcactgagggccgaa<br>gataccgccgtctactactgcgcgagccagtccactccctacgactcgagcgggtactactccggg<br>gacgccttcgacatctggggacagggaactatggtcacggtgtcgtcggggaggagggggcagcggc<br>ggcggaggaagcggggagggggttcgtcctatgtgctgacccagccgccgagcgcctccgggact<br>ccgggccagcgcgtgaccatttcctgctccggctcctcatccaacatcggttcgaattatgtgtac<br>tggtaccagcagctgcctggtactgcccctaagcttctcatctaccggaacaaccagcgcccgtct<br>ggcgtgcccgaccggttctccggctcgaagtccggcaccagcgcctccctggctatctccgggctg<br>agatccgaggatgaggccgactactattgcgcagcgtgggacgacagcctgtcgggatacgtgttt<br>ggaaccggaaccaagctcaccgtgctg |
| CAR22-1 soluble scFV NT | 205 | atggccctccctgtcaccgccctgctgcttccgctggctcttctgctccacgccgctcggccccaa<br>gtgcaactcgtccaatccggcggcggactgattcaaccaggaggttcccttagactctcatgtgcc<br>gctagcggattcactgtgtcctcaaactacatgagctgggtccgccaggcgcccggaaagggcctg<br>gaatgggtgtccgtgatctactcgggcggatcaacctactacgccgattccgtgaagggccggttc<br>accatctcgcgggataactccaagaacaccctgtacttgcaaatgaactcactgagggccgaagat<br>accgccgtctactactgcgcgagccagtccactccctacgactcgagcgggtactactccggggac<br>gccttcgacatctggggacagggaactatggtcacggtgtcgtcggggaggagggggcagcggcgg<br>cggaggaagcggggagggggttcgtcctatgtgctgacccagccgccgagcgcctccgggactccg<br>ggccagcgcgtgaccatttcctgctccggctcctcatccaacatcggttcgaattatgtgtactgg<br>taccagcagctgcctggtactgcccctaagcttctcatctaccggaacaaccagcgcccgtctggc<br>gtgcccgaccggttctccggctcgaagtccggcaccagcgcctccctggctatctccgggctgaga<br>tccgaggatgaggccgactactattgcgcagcgtgggacgacagcctgtcgggatacgtgtttgga<br>accggaaccaagctcaccgtgctgggatcgcaccaccatcaccatcatcatcac |
| CAR22-1 soluble scFV AA | 206 | malpvtalllplalllhaarpqvqlvqsggliqpggslrlscaasgftvssnymswvrqapgkgl<br>ewvsviysggstyyadsvkgrftisrdnskntlylqmnslraedtavyycasqstpydssgyysgd<br>afdiwgqgtmvtvssggggsggggsggggssyvltqppsasgtpgqrvtiscsgsssnigsnyvyw<br>yqqlpgtapklliyrnnqrpsgvpdrfsgsksgtsaslaisglrsedeadyycaawddslsgyvfg<br>tgtkltvlgshhhhhhhh |
| CAR22-1 Full AA | 207 | malpvtalllplalllhaarpqvqlvqsggliqpggslrlscaasgftvssnymswvrqapgkgl<br>ewvsviysggstyyadsvkgrftisrdnskntlylqmnslraedtavyycasqstpydssgyysgd<br>afdiwgqgtmvtvssggggsggggsggggssyvltqppsasgtpgqrvtiscsgsssnigsnyvyw<br>yqqlpgtapklliyrnnqrpsgvpdrfsgsksgtsaslaisglrsedeadyycaawddslsgyvfg<br>tgtkltvltttpaprpptpaptiasqplslrpeacrpaaggavhtrgldfacdiyiwaplagtcgv<br>lllslvitlyckrgrkkllyifkqpfmrpvqttqeedgcscrfpeeeeggcelrvkfsrsadapay<br>kqgqnqlynelnlgrreeydvldkrrgrdpemggkprrknpqeglynelqkdkmaeayseigmkge<br>rrrgkghdglyqglstatkdtydalhmqalppr |
| CAR22-1 Full NT lentivirus | 208 | atggccctccctgtcaccgccctgctgcttccgctggctcttctgctccacgccgctcggccccaa<br>gtgcaactcgtccaatccggcggcggactgattcaaccaggaggttcccttagactctcatgtgcc<br>gctagcggattcactgtgtcctcaaactacatgagctgggtccgccaggcgcccggaaagggcctg<br>gaatgggtgtccgtgatctactcgggcggatcaacctactacgccgattccgtgaagggccggttc<br>accatctcgcgggataactccaagaacaccctgtacttgcaaatgaactcactgagggccgaagat<br>accgccgtctactactgcgcgagccagtccactccctacgactcgagcgggtactactccggggac<br>gccttcgacatctggggacagggaactatggtcacggtgtcgtcggggaggagggggcagcggcgc |

TABLE 6A-continued

Human CD22 CAR Constructs

| Name | SEQ ID | Sequence |
| --- | --- | --- |
| | | ggaggaagcggggaggggttcgtcctatgtgctgacccagccgccgagcgcctccgggactccg<br>ggccagcgcgtgaccatttcctgctccggctcctcatccaacatcggttcgaattatgtgtactgg<br>taccagcagctgcctggtactgcccctaagcttctcatctaccggaacaaccagcgcccgtctggc<br>gtgcccgaccggttctccggctcgaagtccggcaccagcgcctcctggctatctccgggctgaga<br>tccgaggatgaggccgactactattgcgcagcgtgggacgacagcctgtcgggatacgtgtttgga<br>accggaaccaagctcaccgtgctgaccactaccccagcaccgaggccacccaccccggctcctacc<br>atcgcctcccagcctctgtccctcgcgtccggaggcatgtagacccgcagctggtggggccgtgcat<br>acccgggggtcttgacttcgcctgcgatatctacatttgggcccctctggctggtacttgcgggggtc<br>ctgctgctttcactcgtgatcactcttactgtaagcgcggtcggaagaagctgctgtacatcttt<br>aagcaacccttcatgaggcctgtgcagactactcaagaggaggacggctgttcatgccggttccca<br>gaggaggaggaaggcggctgcgaactgcgcgtgaaattcagccgcagcgcagatgctccagcctac<br>aagcaggggcagaaccagctctacaacgaactcaatcttggtcggagagaggagtacgacgtgctg<br>gacaagcggagaggacgggacccagaaatgggcgggaagccgcgcagaaagaatccccaagagggc<br>ctgtacaacgagctccaaaaggataagatggcagaagcctatagcgagattggtatgaaagggaa<br>cgcagaagaggcaaaggccacgacggactgtaccagggactcagcaccgccaccaaggacacctat<br>gacgctcttcacatgcaggccctgccgcctcgg |
| CAR22-2<br>scFv<br>AA | 209 | evqlqqsgpglvkpsqtlsltcaisgdsvssnsaawnwirqspsrglewlgrtyyrskwyndyavs<br>vksritinpdtsknqfslqlnsvtpedtavyycardlgwiavagtfdywgqgtlvtvssggggsgg<br>ggsggggsqsaltqpasvsgspgqsitisctgtssdvggynyvswyqqhpgkapklmiydvskrps<br>gvsnrfsgsksgntasltisglqaedeadyycssytsssslnhvfgtgtkvtvl |
| CAR22-2<br>scFv NT | 210 | gaagtgcaactccaacagagcggacccggacttgtgaaaccatcccagactctcagcctgacgtgt<br>gcgatcagcggggactctgtgtcctccaactccgccgcctggaactggattaggcagtcgccgtcg<br>agagggctggagtggttgggtagaacctactaccggtccaagtggtacaatgactacgccgtgtcc<br>gtgaagtcccggatcactattaacccggataccctcaaagaaccagttctccctgcaactgaactcg<br>gtgaccccctgaggacaccgcagtgtactactgcgcccgggatctgggttggatcgctgtcgccggc<br>accttcgactattggggacagggcactctcgtgaccgtgtcgtcgggtggaggagggagcggaggg<br>ggcggaagcggtggcggcggttcccagtccgcgctgacccagcctgctagcgtgtccgggtcgccc<br>ggacagtcaatcaccatctcctgcactgggactagcagcgacgtgggcggctacaactacgtgtca<br>tggtaccagcagcacccgggaaaggcgcccaagctgatgatctacgacgtgtccaagcgcccttcg<br>ggagtctccaaccgctttagcggctccaagtcgggcaacactgcctccctgaccattagcggactg<br>caggccgaagatgaggccgactattactgctcatcctacacctcctcctcactgaaccatgtgttc<br>ggcaccggaaccaaggtcacagtcctc |
| CAR22-2<br>soluble<br>scFV NT | 211 | atggcccctcctgtcaccgccctgctgcttccgctggctcttctgctccacgccgctcggcccgaa<br>gtgcaactccaacagagcggacccggacttgtgaaaccatcccagactctcagcctgacgtgtgcg<br>atcagcggggactctgtgtcctccaactccgccgcctggaactggattaggcagtcgccgtcgaga<br>gggctggagtggttgggtagaacctactaccggtccaagtggtacaatgactacgccgtgtccgtg<br>aagtcccggatcactattaacccggataccctcaaagaaccagttctccctgcaactgaactcggtg<br>accccctgaggacaccgcagtgtactactgcgcccgggatctgggttggatcgctgtcgccggcacc<br>ttcgactattggggacagggcactctcgtgaccgtgtcgtcgggtggaggagggagcggagggggc<br>ggaagcggtggcggcggttcccagtccgcgctgacccagcctgctagcgtgtccgggtcgcccgga<br>cagtcaatcaccatctcctgcactgggactagcagcgacgtgggcggctacaactacgtgtcatgg<br>taccagcagcacccgggaaaggcgcccaagctgatgatctacgacgtgtccaagcgcccttcggga<br>gtctccaaccgctttagcggctccaagtcgggcaacactgcctccctgaccattagcggactgcag<br>gccgaagatgaggccgactattactgctcatcctacacctcctcctcactgaaccatgtgttcggc<br>accggaaccaaggtcacagtcctcggatcgcaccaccatcaccatcatcac |
| CAR22-2<br>soluble<br>scFV AA | 212 | Malpvtallllplallllhaarpevqlqqsgpglvkpsqtlsltcaisgdsvssnsaawnwirqspsr<br>glewlgrtyyrskwyndyavsvksritinpdtsknqfslqlnsvtpedtavyycardlgwiavagt<br>fdywgqgtlvtvssggggsggggsggggsqsaltqpasvsgspgqsitisctgtssdvggynyvsw<br>yqqhpgkapklmiydvskrpsgvsnrfsgsksgntasltisglqaedeadyycssytsssslnhvfg<br>tgtkvtvlgshhhhhhhh |
| CAR22-2<br>Full AA | 213 | malpvtallllplallllhaarpevqlqqsgpglvkpsqtlsltcaisgdsvssnsaawnwirqspsr<br>glewlgrtyyrskwyndyavsvksritinpdtsknqfslqlnsvtpedtavyycardlgwiavagt<br>fdywgqgtlvtvssggggsggggsggggsqsaltqpasvsgspgqsitisctgtssdvggynyvsw<br>yqqhpgkapklmiydvskrpsgvsnrfsgsksgntasltisglqaedeadyycssytsssslnhvfg<br>tgtkvtvltttpaprpptpaptiasqplslrpeacrpaaggavhtrgldfacdiyiwaplagtcgv<br>lllslvitlyckrgrkkllyifkqpfmrpvqttqeedgcscrfpeeeeggcelrvkfsrsadapay<br>kqgqnqlynelnlgrreeydvldkrrgrdpemggkprrknpqeglynelqkdkmaeayseigmkge<br>rrrgkghdglyqglstatkdtydalhmqalppr |
| CAR22-2<br>Full NT<br>lentivirus | 214 | atggcccctcctgtcaccgccctgctgcttccgctggctcttctgctccacgccgctcggcccgaa<br>gtgcaactccaacagagcggacccggacttgtgaaaccatcccagactctcagcctgacgtgtgcg<br>atcagcggggactctgtgtcctccaactccgccgcctggaactggattaggcagtcgccgtcgaga<br>gggctggagtggttgggtagaacctactaccggtccaagtggtacaatgactacgccgtgtccgtg<br>aagtcccggatcactattaacccggataccctcaaagaaccagttctccctgcaactgaactcggtg<br>accccctgaggacaccgcagtgtactactgcgcccgggatctgggttggatcgctgtcgccggcacc<br>ttcgactattggggacagggcactctcgtgaccgtgtcgtcgggtggaggagggagcggagggggc<br>ggaagcggtggcggcggttcccagtccgcgctgacccagcctgctagcgtgtccgggtcgcccgga<br>cagtcaatcaccatctcctgcactgggactagcagcgacgtgggcggctacaactacgtgtcatgg<br>taccagcagcacccgggaaaggcgcccaagctgatgatctacgacgtgtccaagcgcccttcggga<br>gtctccaaccgctttagcggctccaagtcgggcaacactgcctccctgaccattagcggactgcag<br>gccgaagatgaggccgactattactgctcatcctacacctcctcctcactgaaccatgtgttcggc |

TABLE 6A-continued

Human CD22 CAR Constructs

| Name | SEQ ID | Sequence |
|---|---|---|
| | | accggaaccaaggtcacagtcctcaccactaccccagcaccgaggccacccaccccggctcctacc<br>atcgcctcccagcctctgtccctgcgtccggaggcatgtagacccgcagctggtggggccgtgcat<br>acccgggggtcttgacttcgcctgcgatatctacatttgggcccctctggctggtacttgcggggtc<br>ctgctgctttcactcgtgatcactctttactgtaagcgcggtcggaagaagctgctgtacatctttt<br>aagcaaccttcatgaggcctgtgcagactactcaagaggaggacggctgttcatgccggttccca<br>gaggaggaggaaggcggctgcgaactgcgcgtgaaattcagccgcagcgcagatgctccagcctac<br>aagcaggggcagaaccagctctacaacgaactcaatcttggtcggagagaggagtacgacgtgctg<br>gacaagcggagaggacgggacccagaaatgggcgggaagccgcgcagaaagaatcccaagagggc<br>ctgtacaacgagctccaaaaggataagatggcagaagcctatagcgagattggtatgaaagggggaa<br>cgcagaagaggcaaaggccacgacggactgtaccagggactcagcaccgccaccaaggacacctat<br>gacgctcttcacatgcaggccctgccgcctcgg |
| CAR22-3 scFv AA | 215 | evqlqqsgpglvkpsqtlsltcaisgdsvlsnsdtwnwirqspsrglewlgrtyhrstwyddyass<br>vrgrvsinvdtsknqyslqlnavtpedtgayycardrlqdgnswsdafdvwgqgtmvtvssggggs<br>ggggsggggsqsaltqpasvsgspgqsitisctgtssdvggynyvswyqqhpgkapklmiydvsnr<br>psgvsnrfsgsksgntasltisglqaedeadyycssytssstpyvfgtgtqltvl |
| CAR22-3 scFv NT | 216 | gaagtgcaactccaacagagcggacccggacttgtgaaaccttcccaaactctctccctgacctgt<br>gcgatctctggggattcggtgctgtcgaatagcgacacctggaactggatcagacagtcaccctcc<br>cggggcctggagtggctcgggagaacttaccaccggtccacttggtacgacgactatgccagctca<br>gtgcgcggaagggtgtccattaacgtggacacctccaagaaccagtacagcctgcagttgaacgct<br>gtgaccccggaagataccggagcctactactgcgcccgcgaccggctgcaggacggaaactcctgg<br>tccgatgccttcgacgtctgggccagggaaccatggtcactgtgtcatccggcggtggcggttcg<br>ggcggtggtggcagcggtggaggcggctcccagtcggcactgactcagccagcttcagtctccggc<br>tcgccggacagtccatcaccatttcctgcactggaaccagctccgatgtcgggggtataactac<br>gtgtcgtggtaccagcaacatcctggaaaggcccccaagctcatgatctacgacgtgtccaatcgc<br>cctagcggagtgtcaaaccggttttccggctccaagtccgggaacaccgcgtccctgacaatcagc<br>ggactgcaggccgaggacgaagccgactactactgctcgagctacaccagctcgtccacgccgtac<br>gtgttcggaactgggacccagctgaccgtgctg |
| CAR22-3 soluble scFV NT | 217 | atggccctccctgtcaccgccctgctgcttccgctggctcttctgctccacgccgctcggcccgaa<br>gtgcaactccaacagagcggacccggacttgtgaaaccttcccaaactctctccctgacctgtgcg<br>atctctggggattcggtgctgtcgaatagcgacacctggaactggatcagacagtcaccctcccgg<br>ggcctggagtggctcgggagaacttaccaccggtccacttggtacgacgactatgccagctcagtg<br>cgcggaagggtgtccattaacgtggacacctccaagaaccagtacagcctgcagttgaacgctgtg<br>accccggaagataccggagcctactactgcgcccgcgaccggctgcaggacggaaactcctggtcc<br>gatgccttcgacgtctgggccagggaaccatggtcactgtgtcatccggcggtggcggttcgggc<br>ggtggtggcagcggtggaggcggctcccagtcggcactgactcagccagcttcagtctccggctcg<br>ccggacagtccatcaccatttcctgcactggaaccagctccgatgtcgggggtataactacgtg<br>tcgtggtaccagcaacatcctggaaaggcccccaagctcatgatctacgacgtgtccaatcgccct<br>agcggagtgtcaaaccggttttccggctccaagtccgggaacaccgcgtccctgacaatcagcgga<br>ctgcaggccgaggacgaagccgactactactgctcgagctacaccagctcgtccacgccgtacgtg<br>ttcggaactgggacccagctgaccgtgctgggatcgcaccaccatcaccatcatcac |
| CAR22-3 soluble scFV AA | 218 | malpvtalllplalllhaarpevqlqqsgpglvkpsqtlsltcaisgdsvlsnsdtwnwirqspsr<br>glewlgrtyhrstwyddyassvrgrvsinvdtsknqyslqlnavtpedtgayycardrlqdgnsws<br>dafdvwgqgtmvtvssggggsggggsggggsqsaltqpasvsgspgqsitisctgtssdvggynyv<br>swyqqhpgkapklmiydvsnrpsgvsnrfsgsksgntasltisglqaedeadyycssytssstpyv<br>fgtgtqltvlgshhhhhhhh |
| CAR22-3 Full AA | 219 | malpvtalllplalllhaarpevqlqqsgpglvkpsqtlsltcaisgdsvlsnsdtwnwirqspsr<br>glewlgrtyhrstwyddyassvrgrvsinvdtsknqyslqlnavtpedtgayycardrlqdgnsws<br>dafdvwgqgtmvtvssggggsggggsggggsqsaltqpasvsgspgqsitisctgtssdvggynyv<br>swyqqhpgkapklmiydvsnrpsgvsnrfsgsksgntasltisglqaedeadyycssytssstpyv<br>fgtgtqltvltttpaprpptpaptiasqplslrpeacrpaaggavhtrgldfacdiyiwaplagtc<br>gvlllslvitlyckrgrkkllyifkqpfmrpvqttqeedgcscrfpeeeeggcelrvkfsrsadap<br>aykqgqnqlynelnlgrreeydvldkrrgrdpemggkprrknpqeglynelqkdkmaeayseigmk<br>gerrrgkghdglyqglstatkdtydalhmqalppr |
| CAR22-3 Full NT lentivirus | 220 | atggccctccctgtcaccgccctgctgcttccgctggctcttctgctccacgccgctcggcccgaa<br>gtgcaactccaacagagcggacccggacttgtgaaaccttcccaaactctctccctgacctgtgcg<br>atctctggggattcggtgctgtcgaatagcgacacctggaactggatcagacagtcaccctcccgg<br>ggcctggagtggctcgggagaacttaccaccggtccacttggtacgacgactatgccagctcagtg<br>cgcggaagggtgtccattaacgtggacacctccaagaaccagtacagcctgcagttgaacgctgtg<br>accccggaagataccggagcctactactgcgcccgcgaccggctgcaggacggaaactcctggtcc<br>gatgccttcgacgtctgggccagggaaccatggtcactgtgtcatccggcggtggcggttcgggc<br>ggtggtggcagcggtggaggcggctcccagtcggcactgactcagccagcttcagtctccggctcg<br>ccggacagtccatcaccatttcctgcactggaaccagctccgatgtcgggggtataactacgtg<br>tcgtggtaccagcaacatcctggaaaggcccccaagctcatgatctacgacgtgtccaatcgccct<br>agcggagtgtcaaaccggttttccggctccaagtccgggaacaccgcgtccctgacaatcagcgga<br>ctgcaggccgaggacgaagccgactactactgctcgagctacaccagctcgtccacgccgtacgtg<br>ttcggaactgggacccagctgaccgtgctgaccactaccccagcaccgaggccacccaccccggct<br>cctaccatcgcctcccagcctctgtccctgcgtccggaggcatgtagacccgcagctggtgggcc<br>gtgcatacccgggggtcttgacttcgcctgcgatatctacatttgggcccctctggctggtacttgc<br>ggggtcctgctgctttcactcgtgatcactctttactgtaagcgcggtcggaagaagctgctgtac<br>atctttaagcaaccttcatgaggcctgtgcagactactcaagaggaggacggctgttcatgccgg |

TABLE 6A-continued

Human CD22 CAR Constructs

| Name | SEQ ID | Sequence |
|---|---|---|
| | | ttcccagaggaggaggaaggcggctgcgaactgcgcgtgaaattcagccgcagcgcagatgctcca<br>gcctacaagcagggcagaaccagctctacaacgaactcaatcttggtcggagagaggagtacgac<br>gtgctggacaagcggagaggacgggacccagaaatgggcgggaagccgcgcagaaagaatccccaa<br>gagggcctgtacaacgagctccaaaaggataagtggcagaagcctatagcgagattggtatgaaa<br>gggaacgcagaagaggcaaaggccacgacggactgtaccagggactcagcaccgccaccaaggac<br>acctatgacgctcttcacatgcaggccctgccgcctcgg |
| CAR22-4<br>scFv<br>AA | 221 | evqlvesggglvqpgrslrlscaasgftfddyamhwvrqapgkglewvsgiswnsgsigyadsvkg<br>rftisrdnaknslylqmnslraedtalyycakglsswhfhdaldiwgqgtmvtvssggggsggggs<br>ggggssseltqdpavsvalgqtvritcqgdslrsyyaswyqqkpgqapvlviygknnrpsgipdrf<br>sgsssgntasltitgaqaededadyycnsrdssgnhlwvfgggtkltvl |
| CAR22-4<br>scFv NT | 222 | gaagtgcagttggtggaatcaggaggaggacttgtgcaacctggaagatctctcagactctcgtgt<br>gcggcctccggtttcaccttcgacgactacgccatgcattgggtcagacaggccccgggaaagggc<br>ctggagtgggtgtcaggcatctcatggaacagcggctccattggctacgccgactcggtcaaggga<br>aggttcactatctcccgggacaacgccaagaactccctgtacctccaaatgaacagcctgcgcgcc<br>gaggatactgccctgtactactgcgccaaggggctgtccagctggcacttttcacgacgcacttgat<br>atctggggacagggtaccatggtcaccgtgtcctccggtggcggaggctcagggggaggaggaagc<br>ggggcggtggttcctcctccgaactgacccaggacccggccgtgtccgtggcgctgggacaaacc<br>gtgcgcattacttgccagggcgacagcttgcggtcgtactacgcctcgtggtaccagcagaagccc<br>ggccaggctcccgtgctggtcatctatggcaaaaacaaccgcccgagcggaattccagaccggttc<br>tccgggagctcgtccgggaacaccgcttcgctcaccatcacgggggcccaggcggaggacgaagca<br>gattactactgcaactcgcgggattccagcggcaatcacctctgggtgttcggggcggaaccaag<br>ctgactgtgctg |
| CAR22-4<br>soluble<br>scFV NT | 223 | atggccctcccctgtcaccgccctgctgcttccgctggctcttctgctccacgccgctcggcccgaa<br>gtgcagttggtggaatcaggaggaggacttgtgcaacctggaagatctctcagactctcgtgtgcg<br>gcctccggtttcaccttcgacgactacgccatgcattgggtcagacaggccccgggaaagggcctg<br>gagtgggtgtcaggcatctcatggaacagcggctccattggctacgccgactcggtcaagggaagg<br>ttcactatctcccgggacaacgccaagaactccctgtacctccaaatgaacagcctgcgcgccgag<br>gatactgccctgtactactgcgccaaggggctgtccagctggcacttttcacgacgcacttgatatc<br>tggggacagggtaccatggtcaccgtgtcctccggtggcggaggctcagggggaggaggaagcggg<br>ggcggtggttcctcctccgaactgacccaggacccggccgtgtccgtggcgctgggacaaaccgtg<br>cgcattacttgccagggcgacagcttgcggtcgtactacgcctcgtggtaccagcagaagcccggc<br>caggctcccgtgctggtcatctatggcaaaaacaaccgcccgagcggaattccagaccggttctcc<br>gggagctcgtccgggaacaccgcttcgctcaccatcacgggggcccaggcggaggacgaagcagat<br>tactactgcaactcgcgggattccagcggcaatcacctctgggtgttcggggcggaaccaagctg<br>actgtgctgggatcgcaccaccatcaccatcatcac |
| CAR22-4<br>soluble<br>scFV AA | 224 | malpvtallllplalllhaarpevqlvesggglvqpgrslrlscaasgftfddyamhwvrqapgkgl<br>ewvsgiswnsgsigyadsvkgrftisrdnaknslylqmnslraedtalyycakglsswhfhdaldi<br>wgqgtmvtvssggggsggggsggggssseltqdpavsvalgqtvritcqgdslrsyyaswyqqkpg<br>qapvlviygknnrpsgipdrfsgsssgntasltitgaqaededadyycnsrdssgnhlwvfgggtkl<br>tvlgshhhhhhhh |
| CAR22-4<br>Full AA | 225 | malpvtallllplalllhaarpevqlvesggglvqpgrslrlscaasgftfddyamhwvrqapgkgl<br>ewvsgiswnsgsigyadsvkgrftisrdnaknslylqmnslraedtalyycakglsswhfhdaldi<br>wgqgtmvtvssggggsggggsggggssseltqdpavsvalgqtvritcqgdslrsyyaswyqqkpg<br>qapvlviygknnrpsgipdrfsgsssgntasltitgaqaededadyycnsrdssgnhlwvfgggtkl<br>tvltttpaprpptpaptiasqplslrpeacrpaaggavhtrgldfacdiyiwaplagtcgvlllsl<br>vitlyckrgrkkllyifkqpfmrpvqttqeedgcscrfpeeeeggcelrvkfsrsadapaykqgqn<br>qlynelnlgrreeydvldkrrgrdpemggkprrknpqeglynelqkdkmaeayseigmkgerrrgk<br>ghdglyqglstatkdtydalhmqalppr |
| CAR22-4<br>Full NT<br>lentivirus | 226 | atggccctcccctgtcaccgccctgctgcttccgctggctcttctgctccacgccgctcggcccgaa<br>gtgcagttggtggaatcaggaggaggacttgtgcaacctggaagatctctcagactctcgtgtgcg<br>gcctccggtttcaccttcgacgactacgccatgcattgggtcagacaggccccgggaaagggcctg<br>gagtgggtgtcaggcatctcatggaacagcggctccattggctacgccgactcggtcaagggaagg<br>ttcactatctcccgggacaacgccaagaactccctgtacctccaaatgaacagcctgcgcgccgag<br>gatactgccctgtactactgcgccaaggggctgtccagctggcacttttcacgacgcacttgatatc<br>tggggacagggtaccatggtcaccgtgtcctccggtggcggaggctcagggggaggaggaagcggg<br>ggcggtggttcctcctccgaactgacccaggacccggccgtgtccgtggcgctgggacaaaccgtg<br>cgcattacttgccagggcgacagcttgcggtcgtactacgcctcgtggtaccagcagaagcccggc<br>caggctcccgtgctggtcatctatggcaaaaacaaccgcccgagcggaattccagaccggttctcc<br>gggagctcgtccgggaacaccgcttcgctcaccatcacgggggcccaggcggaggacgaagcagat<br>tactactgcaactcgcgggattccagcggcaatcacctctgggtgttcggggcggaaccaagctg<br>actgtgctgaccactaccccagcaccgaggccacccaccccggctcctaccatcgcctcccagcct<br>ctgtccctgcgtccggaggcatgtagacccgcagctggtggggccgtgcatacccggggtcttgac<br>ttccgctgcgatatctacatttggccctctggcttgtacttgcggggtcctgctgctttcactc<br>gtgatcactctttactgtaagcgcggtcggaagaagctgctgtacatctttaagcaacccttcatg<br>aggcctgtgcagactactcaagaggaggacggctgttcatgccggttcccagaggaggaggaaggc<br>ggctgcgaactgcgcgtgaaattcagccgcagcgcagatgctccagcctacaagcaggggcagaac<br>cagctctacaacgaactcaatcttggtcggagagaggagtacgacgtgctggacaagcggagagga<br>cgggacccagaaatgggcgggaagccgcgcagaaagaatccccaagagggcctgtacaacgagctc |

TABLE 6A-continued

Human CD22 CAR Constructs

| Name | SEQ ID | Sequence |
|---|---|---|
| | | caaaaggataagatggcagaagcctatagcgagattggtatgaaaggggaacgcagaagaggcaaa<br>ggccacgacggactgtaccagggactcagcaccgccaccaaggacacctatgacgctcttcacatg<br>caggccctgccgcctcgg |
| CAR22-5<br>scFv<br>AA | 227 | evqlvesgggglvqpgrslrlscaasgftfddyamhwvrqapgkglewvsgiswnsgsigyadsvkg<br>rftisrdnaknslylqmnslraedtalyycakdkgggyydfwsgsdywgqgtlvtvssggggsggg<br>gsggggssseltqdpavsvalgqtvritcqgdslrsyyaswyqqkpgqapvlviygknnrpsgipd<br>rfsgsssgntasltitgaqaedeadyycnsrdssgwvfgggtkltvl |
| CAR22-5<br>scFv NT | 116 | gaagtgcaacttgtggaatctggtggaggacttgtgcaacctggaagatcactgagactgtcatgt<br>gcagcctcggggtttaccttcgacgactacgccatgcactgggtgcgccaggctccggggaagggc<br>ctcgaatgggtgtcgggcatcagctggaactccggttccattggctatgcggactccgtgaaagga<br>cgcttcacaatttcccgggataacgccaagaacagcctgtacttgcagatgaactccctgcgggcc<br>gaggataccgccctgtactactgcgctaaggacaagggcggtggatactacgacttctggagcgga<br>agcgactactggggacagggaactctggtcaccgtgtcctccggcggaggggggctccggcggcggt<br>ggtagcggggtggaggtcgtcgtcggagctgacccaggaccccgcagtgtccgtcgccctgggg<br>cagactgtgcggatcacttgccaaggagacagcctgcggtcctactacgcgtcctggtatcagcag<br>aagccggggcaggcccagtcctcgtcatctacggaaagaacaataggcccagcggaatccctgac<br>cgcttctcgggctcatcctccggcaacaccgcctccctgaccatcacgggcgcgcaggccgaggac<br>gaagccgattactactgcaactcacgggattccagcggatgggtgttcggaggaggaaccaagctc<br>actgtgctc |
| CAR22-5<br>soluble<br>scFV NT | 228 | atggccctccctgtcaccgccctgctgcttccgctggctcttctgctccacgccgctcggcccgaa<br>gtgcaacttgtggaatctggtggaggacttgtgcaacctggaagatcactgagactgtcatgtgca<br>gcctcggggtttaccttcgacgactacgccatgcactgggtgcgccaggctccggggaagggcctc<br>gaatgggtgtcgggcatcagctggaactccggttccattggctatgcggactccgtgaaaggacgc<br>ttcacaatttcccgggataacgccaagaacagcctgtacttgcagatgaactccctgcgggccgag<br>gataccgccctgtactactgcgctaaggacaagggcggtggatactacgacttctggagcggaagc<br>gactactggggacagggaactctggtcaccgtgtcctccggcggaggggggctccggcggcggtggt<br>agcggggtggaggtcgtcgtcggagctgacccaggaccccgcagtgtccgtcgccctggggcag<br>actgtgcggatcacttgccaaggagacagcctgcggtcctactacgcgtcctggtatcagcagaag<br>ccggggcaggcccagtcctcgtcatctacggaaagaacaataggcccagcggaatccctgaccgc<br>ttctcgggctcatcctccggcaacaccgcctccctgaccatcacgggcgcgcaggccgaggacgaa<br>gccgattactactgcaactcacgggattccagcggatgggtgttcggaggaggaaccaagctcact<br>gtgctcggatcgcaccaccatcaccatcatcac |
| CAR22-5<br>soluble<br>scFV AA | 229 | malpvtalllplalllhaarpevqlvesgggglvqpgrslrlscaasgftfddyamhwvrqapgkgl<br>ewvsgiswnsgsigyadsvkgrftisrdnaknslylqmnslraedtalyycakdkgggyydfwsgs<br>dywgqgtlvtvssggggsggggsggggssseltqdpavsvalgqtvritcqgdslrsyyaswyqqk<br>pgqapvlviygknnrpsgipdrfsgsssgntasltitgaqaedeadyycnsrdssgwvfgggtklt<br>vlgshhhhhhhh |
| CAR22-5<br>Full AA | 230 | malpvtalllplalllhaarpevqlvesgggglvqpgrslrlscaasgftfddyamhwvrqapgkgl<br>ewvsgiswnsgsigyadsvkgrftisrdnaknslylqmnslraedtalyycakdkgggyydfwsgs<br>dywgqgtlvtvssggggsggggsggggssseltqdpavsvalgqtvritcqgdslrsyyaswyqqk<br>pgqapvlviygknnrpsgipdrfsgsssgntasltitgaqaedeadyycnsrdssgwvfgggtklt<br>vltttpaprpptpaptiasqplslrpeacrpaaggavhtrgldfacdiyiwaplagtcgvlllslv<br>itlyckrgrkkllyifkqpfmrpvqttqeedgcscrfpeeeeggcelrvkfsrsadapaykqgqnq<br>lynelnlgrreeydvldkrrgrdpemggkprrknpqeglynelqkdkmaeayseigmkgerrrgkg<br>hdglyqglstatkdtydalhmqalppr |
| CAR22-5<br>Full NT<br>lentivirus | 231 | atggccctccctgtcaccgccctgctgcttccgctggctcttctgctccacgccgctcggcccgaa<br>gtgcaacttgtggaatctggtggaggacttgtgcaacctggaagatcactgagactgtcatgtgca<br>gcctcggggtttaccttcgacgactacgccatgcactgggtgcgccaggctccggggaagggcctc<br>gaatgggtgtcgggcatcagctggaactccggttccattggctatgcggactccgtgaaaggacgc<br>ttcacaatttcccgggataacgccaagaacagcctgtacttgcagatgaactccctgcgggccgag<br>gataccgccctgtactactgcgctaaggacaagggcggtggatactacgacttctggagcggaagc<br>gactactggggacagggaactctggtcaccgtgtcctccggcggaggggggctccggcggcggtggt<br>agcggggtggaggtcgtcgtcggagctgacccaggaccccgcagtgtccgtcgccctggggcag<br>actgtgcggatcacttgccaaggagacagcctgcggtcctactacgcgtcctggtatcagcagaag<br>ccggggcaggcccagtcctcgtcatctacggaaagaacaataggcccagcggaatccctgaccgc<br>ttctcgggctcatcctccggcaacaccgcctccctgaccatcacgggcgcgcaggccgaggacgaa<br>gccgattactactgcaactcacgggattccagcggatgggtgttcggaggaggaaccaagctcact<br>gtgctcaccactacccagcaccaccgaggccaccaccccggctcctaccatcgcctcccagcctctg<br>tcccgtcgctccggaggcatgtagacccgcagctggtggggccgtgcatgcataccggggtcttgacttc<br>gcctgcgatatctacatttgggcccctctggctggtacttgcggggtcctgctgctttcactcgtg<br>atcactctttactgtaagcgcggtcggaagaagctgctgtacatctttaagcaacccttcatgagg<br>cctgtgcagactactcaagaggaggacggctgttcatgccggttcccagaggaggaggaaggcggc<br>tgcgaactgcgcgtgaaattcagccgcagcgcagatgctccagcctacaagcaggggcagaacg<br>ctctacaacgaactcaatcttggtcggagagaggagtacgacgtgctggacaagcggagaggacgg<br>gacccagaaatgggcgggaagccgcgcagaaagaatccccaagagggcctgtacaacgagctccaa<br>aaggataagatggcagaagcctatagcgagattggtatgaaaggggaacgcagaagaggcaaaggc<br>cacgacggactgtaccagggactcagcaccgccaccaaggacacctatgacgctcttcacatgcag<br>gccctgccgcctcgg |

TABLE 6A-continued

Human CD22 CAR Constructs

| Name | SEQ ID | Sequence |
|---|---|---|
| CAR22-6 scFv AA | 232 | evqlqqsgpglvkpsltlsltcaisgdsvssnsatwtwirqspsrglewlgrtyyrstwyndyavs vksritinpdtsknqfslqlnsvtpedtavyycaregsgsyyaywgqgtlvtvssggggsggggsg gggsqsaltqpasvsgspgqsitisctgtssdvggynyvswyqqhpgkapklmiydvsnrpsgvsn rfsgsksgntasltisglqaedeadyycssytssstlyvfgtgtkvtvl |
| CAR22-6 scFv NT | 233 | gaagtgcaactccaacaatcaggtccaggactcgtcaaaccctcgcttactctgtcgctgacttgt gctatctcgggagactccgtgagctccaacagcgccacctggacttggattagacagtccccgtca cggggcctcgaatggctgggaaggacctactaccggagcacctggtacaacgactatgctgtgtcc gtgaagtcccgcatcaccatcaaccccgatacctccaagaaccagttcagcttgcaactgaactcc gtgaccctgaggatacggccgtctattactgcgcccgcgaggggtccggttcctactacgcctac tggggacagggtactctggtcaccgtgtcgagcggaggggggggtccggcggaggaggatctggt ggcggaggctcccagtccgcgctgacccagcctgcgtccgtgtccggctcaccgggccagtctatc accattagctgcaccggcactagctcagacgtggagggtacaactacgtgtcgtggtaccagcag caccctggaaaggccccgaagctgatgatctacgacgtgtccaaccggcccagcggggtgtcgaat cgcttctccggctcaaagtccggcaacacagccagcctgaccattagcggactgcaggccgaggat gaagcagactactactgctcgtcctacacctcctcctcgactctctacgtgtttggcaccggaact aaggtcaccgtgctg |
| CAR22-6 soluble scFV NT | 234 | atggccctccctgtcaccgccctgctgcttccgctggctcttctgctccacgccgctcggcccgaa gtgcaactccaacaatcaggtccaggactcgtcaaaccctcgcttactctgtcgctgacttgtgct atctcgggagactccgtgagctccaacagcgccacctggacttggattagacagtccccgtcacgg ggcctcgaatggctgggaaggacctactaccggagcacctggtacaacgactatgctgtgtccgtg aagtcccgcatcaccatcaaccccgatacctccaagaaccagttcagcttgcaactgaactccgtg acccctgaggatacggccgtctattactgcgcccgcgaggggtccggttcctactacgcctactgg ggacagggtactctggtcaccgtgtcgagcggaggggggggtccggcggaggaggatctggtggc ggaggctcccagtccgcgctgacccagcctgcgtccgtgtccggctcaccgggccagtctatcacc attagctgcaccggcactagctcagacgtggagggtacaactacgtgtcgtggtaccagcagcac cctggaaaggccccgaagctgatgatctacgacgtgtccaaccggcccagcggggtgtcgaatcgc ttctccggctcaaagtccggcaacacagccagcctgaccattagcggactgcaggccgaggatgaa gcagactactactgctcgtcctacacctcctcctcgactctctacgtgtttggcaccggaactaag gtcaccgtgctgggatcgcaccaccatcaccatcatcatcac |
| CAR22-6 soluble scFV AA | 235 | malpvtalllplalllhaarpevqlqqsgpglvkpsltlsltcaisgdsvssnsatwtwirqspsr glewlgrtyyrstwyndyavsvksritinpdtsknqfslqlnsvtpedtavyycaregsgsyyayw gqgtlvtvssggggsggggsggggsqsaltqpasvsgspgqsitisctgtssdvggynyvswyqqh pgkapklmiydvsnrpsgvsnrfsgsksgntasltisglqaedeadyycssytssstlyvfgtgtk vtvlgshhhhhhhh |
| CAR22-6 Full AA | 236 | malpvtalllplalllhaarpevqlqqsgpglvkpsltlsltcaisgdsvssnsatwtwirqspsr glewlgrtyyrstwyndyavsvksritinpdtsknqfslqlnsvtpedtavyycaregsgsyyayw gqgtlvtvssggggsggggsggggsqsaltqpasvsgspgqsitisctgtssdvggynyvswyqqh pgkapklmiydvsnrpsgvsnrfsgsksgntasltisglqaedeadyycssytssstlyvfgtgtk vtvltttpaprrpptpaptiasqplslrpeacrpaaggavhtrgldfacdiyiwaplagtcgvllls lvitlyckrgrkkllyifkqpfmrpvqttqeedgcscrfpeeeeggcelrvkfsrsadapaykqgq nqlynelnlgrreeydvldkrrgrdpemggkprrknpqeglynelqkdkmaeayseigmkgerrrg kghdglyqglstatkdtydalhmqalppr |
| CAR22-6 Full NT lentivirus | 237 | atggccctccctgtcaccgccctgctgcttccgctggctcttctgctccacgccgctcggcccgaa gtgcaactccaacaatcaggtccaggactcgtcaaaccctcgcttactctgtcgctgacttgtgct atctcgggagactccgtgagctccaacagcgccacctggacttggattagacagtccccgtcacgg ggcctcgaatggctgggaaggacctactaccggagcacctggtacaacgactatgctgtgtccgtg aagtcccgcatcaccatcaaccccgatacctccaagaaccagttcagcttgcaactgaactccgtg acccctgaggatacggccgtctattactgcgcccgcgaggggtccggttcctactacgcctactgg ggacagggtactctggtcaccgtgtcgagcggaggggggggtccggcggaggaggatctggtggc ggaggctcccagtccgcgctgacccagcctgcgtccgtgtccggctcaccgggccagtctatcacc attagctgcaccggcactagctcagacgtggagggtacaactacgtgtcgtggtaccagcagcac cctggaaaggccccgaagctgatgatctacgacgtgtccaaccggcccagcggggtgtcgaatcgc ttctccggctcaaagtccggcaacacagccagcctgaccattagcggactgcaggccgaggatgaa gcagactactactgctcgtcctacacctcctcctcgactctctacgtgtttggcaccggaactaag gtcaccgtgctgaccactaccccagcaccgaggcacccaccccggctcctaccatgcctcccag cctctgtccctgcgtccggaggcatgtagacccgcagctggtggggccgtgcatacccggggtctt gacttcgcctgcgatatctacatttgggccctctggctgctacttgcggggtcctgctgctttca ctcgtgatcactctttactgtaagcgcggtcggaagaagctgctgtacatctttaagcaaccctttc atgaggcctgtgcagactactcaagaggaggacggctgttcatgccggttcccagaggaggaggaa ggcggctgcgaactgcgcgtgaaattcagccgcagcgcagatgctccagcctacaagcaggggcag aaccagctctacaacgaactcaatcttggtcggagagaggatctacgacgtgctggacaagcggaga ggacgggacccagaaatgggcgggaagccgcgcagaaagaatcccaagagggcctgtacaacgag ctccaaaaggataagatggcagaagcctatagcgagattggtatgaaaggggaacgcagaagaggc aaaggccacgacggactgtaccagggactcagcaccgccaccaaggacacctatgacgctcttcac atgcaggccctgccgcctcgg |
| CAR22-7 scFv AA | 238 | qvqlvqsgaevkkpgasvkvsckasgytftgyymhwvrqapgqglewmgwinpnsggtnyaqkfqg rvtmtrdtsistaymelsrlrsddtavyycardywgyygsgtldywgqgtlvtvssggggsggggs gggsqsaltqpgsvsgspgqsitisctgtssdvggynyvswyqqhpgkapkliiydvssrpsgvs nrfsgsqsgntasltisglqaedeadyscssyagsntlvfgtgtkvtvl |

TABLE 6A-continued

Human CD22 CAR Constructs

| Name | SEQ ID | Sequence |
|---|---|---|
| CAR22-7 scFv NT | 239 | caagtccaactcgtccagtccggtgcagaagtcaagaagccaggagcgtccgtgaaagtgtcctgc
aaaagcctcgggctacaccttcaccggatactacatgcactgggtgcgccaggctcccggacaagga
ttggagtggatgggttggatcaacccgaactccggcggaaccaactacgcccagaagttccaggga
cgcgtgactatgactcgggacacgtccatcagcactgcctacatggaactgagccggcttagatca
gacgacaccgccgtgtactactgcgcccgcgattactggggctactacggaagcggaaccctcgac
tactggggacagggaactctcgtgactgtgtcgagcggtggaggcggctccggcggaggggttcc
ggtggtggaggctcccagtccgcgctgacccagcctgggtcggtgtccggctcacctggccaatcc
atcaccatttcctgcaccggcacttcctccgacgtgggagggtacaactacgtgtcgtggtaccag
cagcatccgggaaaggcccccaagctgatcatctacgatgtgtcgtcccggccgagcggagtgtca
aacaggtttagcggggagccagtccgggaatactgcctcgctgacaattagcgggctgcaggctgag
gacgaggccgattattcgtgttcctcatatgcgggctctaacaccctggtgttcggcaccgggacc
aaggtcaccgtgctg |
| CAR22-7 soluble scFV NT | 240 | atggccctccctgtcaccgccctgctgcttccgctggctcttctgctccacgccgctcggccccaa
gtccaactcgtccagtccggtgcagaagtcaagaagccaggagcgtccgtgaaagtgtcctgcaaa
gcctcgggctacaccttcaccggatactacatgcactgggtgcgccaggctcccggacaaggattg
gagtggatgggttggatcaacccgaactccggcggaaccaactacgcccagaagttccagggacgc
gtgactatgactcgggacacgtccatcagcactgcctacatggaactgagccggcttagatcagac
gacaccgccgtgtactactgcgcccgcgattactggggctactacggaagcggaaccctcgactac
tggggacagggaactctcgtgactgtgtcgagcggtggaggcggctccggcggaggggttccggt
ggtggaggctcccagtccgcgctgacccagcctgggtcggtgtccggctcacctggccaatccatc
accatttcctgcaccggcacttcctccgacgtgggagggtacaactacgtgtcgtggtaccagcag
catccgggaaaggcccccaagctgatcatctacgatgtgtcgtcccggccgagcggagtgtcaaac
aggtttagcggggagccagtccgggaatactgcctcgctgacaattagcgggctgcaggctgaggac
gaggccgattattcgtgttcctcatatgcgggctctaacaccctggtgttcggcaccgggaccaag
gtcaccgtgctgggatcgcaccaccatcaccatcatcac |
| CAR22-7 soluble scFV AA | 241 | malpvtalllplalllhaarpqvqlvqsgaevkkpgasvkvsckasgytftgyymhwvrqapgqgl
ewmgwinpnsggtnyaqkfqgrvtmtrdtsistaymelsrlrsddtavyycardywgyygsgtldy
wgqgtlvtvssggggsggggsggggsqsaltqpgsvsgspgqsitisctgtssdvggynyvswyqq
hpgkapkliiydvssrpsgvsnrfsgsqsgntasltisglqaededadyscssyagsntlvfgtgtk
vtvlgshhhhhhhh |
| CAR22-7 Full AA | 242 | malpvtalllplalllhaarpqvqlvqsgaevkkpgasvkvsckasgytftgyymhwvrqapgqgl
ewmgwinpnsggtnyaqkfqgrvtmtrdtsistaymelsrlrsddtavyycardywgyygsgtldy
wgqgtlvtvssggggsggggsggggsqsaltqpgsvsgspgqsitisctgtssdvggynyvswyqq
hpgkapkliiydvssrpsgvsnrfsgsqsgntasltisglqaededadyscssyagsntlvfgtgtk
vtvltttpaprrpptpaptiasqplslrpeacrpaaggavhtrgldfacdiyiwaplagtcgvllls
lvitlyckrgrkkllyifkqpfmrpvqttqeedgcscrfpeeeeggcelrvkfsrsadapaykqgq
nqlynelnlgrreeydvldkrrgrdpemggkprrknpqeglynelqkdkmaeayseigmkgerrrg
kghdglyqglstatkdtydalhmqalppr |
| CAR22-7 Full NT lentivirus | 243 | atggccctccctgtcaccgccctgctgcttccgctggctcttctgctccacgccgctcggccccaa
gtccaactcgtccagtccggtgcagaagtcaagaagccaggagcgtccgtgaaagtgtcctgcaaa
gcctcgggctacaccttcaccggatactacatgcactgggtgcgccaggctcccggacaaggattg
gagtggatgggttggatcaacccgaactccggcggaaccaactacgcccagaagttccagggacgc
gtgactatgactcgggacacgtccatcagcactgcctacatggaactgagccggcttagatcagac
gacaccgccgtgtactactgcgcccgcgattactggggctactacggaagcggaaccctcgactac
tggggacagggaactctcgtgactgtgtcgagcggtggaggcggctccggcggaggggttccggt
ggtggaggctcccagtccgcgctgacccagcctgggtcggtgtccggctcacctggccaatccatc
accatttcctgcaccggcacttcctccgacgtgggagggtacaactacgtgtcgtggtaccagcag
catccgggaaaggcccccaagctgatcatctacgatgtgtcgtcccggccgagcggagtgtcaaac
aggtttagcggggagccagtccgggaatactgcctcgctgacaattagcgggctgcaggctgaggac
gaggccgattattcgtgttcctcatatgcgggctctaacaccctggtgttcggcaccgggaccaag
gtcaccgtgctgaccactaccccagcaccgaggccacccaccccggctcctaccatcgcctcccag
cctctgtccctcgctccggaggcatgtagacccgcagctggtggggccgtgcatacccggggtctt
gacttcgcctgcgatatctacatttgggcccctctggctggtacttgcggggtcctgctgctttca
ctcgtgatcactcttttactgtaagcgcggtcggaagaagctgctgtacatctttaagcaacccttc
atgaggcctgtgcagactactcaagaggaggacggctgttcatgccggttcccagaggaggagaa
ggcggctgcgaactgcgcgtgaaattcagccgcagcgcagatgctccagcctacaagcaggggcag
aaccagctctacaacgaactcaatcttggtcggagagaggagtacgacgtgctggacaagcggaga
ggacgggacccagaaatgggcgggaagccgcgcgtacaacgag
ctccaaaaggataagatggcagaagcctatagcgagattggtatgaaaggggaacgcagaagaggc
aaaggccacgacggactgtaccaggactcagcaccgccaccaaggacacctatgacgctcttcac
atgcaggccctgccgcctcgg |
| CAR22-8 scFv AA | 244 | qvqlvqsgaevkkpgasvkvsckasgytftsygiswvrqapgqglewmgwisayngntnyaqklqg
rvtmttdtststaymelsrlrsddtavyycaraglalysnyvpyyyygmdvwgqgttvtvssgggg
sggggsggggsnfmltqphsvsespgktvtisctrssgsiasnyvqwyqqrpgsspttviyednqr
psgvpdrfsgsidsssnsasltisglkteedeadyycqsydssnpwvfgggtkltvl |
| CAR22-8 scFv NT | 245 | caagtccaactggtgcagtcgggagccgaagtcaagaagccggggcctccgtcaaagtgtcctgc
aaaagccagcggctacacttcacctcctatgggatctcatgggtcagacaggctcccggccaagga
ctggaatggatgggttggatctccgcctacaacggcaacactaactacgcccagaagctgcagggg
agagtgaccatgacaactgacacctcgacctcaaccgcgtacatggaactgcgcagcctaggtcc |

TABLE 6A-continued

Human CD22 CAR Constructs

| Name | SEQ ID | Sequence |
|---|---|---|
| | | gacgatacggcggtgtactattgtgcacgggccggcttggccctctactcgaactacgtgccctac<br>tactactacggaatggacgtctggggacagggaaccactgtgaccgtgtcctccgggggtggaggc<br>tcaggcggaggaggaagcggcggggtggaagcaactttatgctgacccagcctcactcggtgtcg<br>gagagccctggaaagactgtgaccatctcctgcactcggagctcgggctccattgcgtcaaactac<br>gtgcagtggtaccagcagcgccccggttcctcgccaaccaccgtgatctacgaggacaaccaacgc<br>ccgtccggggtgcctgaccggttctccggctccatcgattcctcttccaactccgcttccctgacc<br>attagcggcctcaagaccgaggatgaagccgactactactgccagtcctacgactcaagcaatccg<br>tgggtgttcggtggaggaactaagctgaccgtgctc |
| CAR22-8<br>soluble<br>scFV NT | 246 | atggccctccctgtcaccgccctgctgcttccgctggctcttctgctccacgccgctcggccccaa<br>gtccaactggtgcagtcggagccgaagtcaagaagccgggggcctccgtcaaagtgtcctgcaaa<br>gccagcggctacactttcacctcctatgggatctcatgggtcagacaggctcccggccaaggactg<br>gaatggatgggttggatctccgcctacaacggcaacactaactacgcccagaagctgcagggggaga<br>gtgaccatgacaactgacacctcgacctcaaccgcgtacatggaactgcgcagccttaggtccgac<br>gatacggcggtgtactattgtgcacgggccggcttggccctctactcgaactacgtgccctactac<br>tactacggaatggacgtctggggacagggaaccactgtgaccgtgtcctccgggggtggaggctca<br>ggcggaggaggaagcggcggggtggaagcaactttatgctgacccagcctcactcggtgtcggag<br>agccctggaaagactgtgaccatctcctgcactcggagctcgggctccattgcgtcaaactacgtg<br>cagtggtaccagcagcgccccggttcctcgccaaccaccgtgatctacgaggacaaccaacgcccg<br>tccggggtgcctgaccggttctccggctccatcgattcctcttccaactccgcttccctgaccatt<br>agcggcctcaagaccgaggatgaagccgactactactgccagtcctacgactcaagcaatccgtgg<br>gtgttcggtggaggaactaagctgaccgtgctcggatcgcaccaccatcaccatcatcac |
| CAR22-8<br>soluble<br>scFV AA | 247 | malpvtalllplalllhaarpqvqlvqsgaevkkpgasvkvsckasgytftsygiswvrqapgqgl<br>ewmgwisayngntnyaqklqgrvtmtdtststaymelrslrsddtavyycaraglalysnyvpyy<br>yygmdvwgqgttvtvssggggsggggsggggsnfmltqphsvsespgktvtisctrsssgsiasnyv<br>qwyqqrpgssptttviyednqrpsgvpdrfsgsidsssnsasltisglktedeadyycqsydssnpw<br>vfgggtkltvlgshhhhhhhh |
| CAR22-8<br>Full AA | 248 | malpvtalllplalllhaarpqvqlvqsgaevkkpgasvkvsckasgytftsygiswvrqapgqgl<br>ewmgwisayngntnyaqklqgrvtmtdtststaymelrslrsddtavyycaraglalysnyvpyy<br>yygmdvwgqgttvtvssggggsggggsggggsnfmltqphsvsespgktvtisctrsssgsiasnyv<br>qwyqqrpgssptttviyednqrpsgvpdrfsgsidsssnsasltisglktedeadyycqsydssnpw<br>vfgggtkltvltttpaprpptpaptiasqplslrpeacrpaaggavhtrgldfacdiyiwaplagt<br>cgvlllslvitlyckrgrkkllyifkqpfmrpvqttqeedgcscrfpeeeeggcelrvkfsrsada<br>paykqgqnqlynelnlgrreeydvldkrrgrdpemggkprrknpqeglynelqkdkmaeayseigm<br>kgerrrgkghdglyqglstatkdtydalhmqalppr |
| CAR22-8<br>Full NT<br>lentivirus | 249 | atggccctccctgtcaccgccctgctgcttccgctggctcttctgctccacgccgctcggccccaa<br>gtccaactggtgcagtcggagccgaagtcaagaagccgggggcctccgtcaaagtgtcctgcaaa<br>gccagcggctacactttcacctcctatgggatctcatgggtcagacaggctcccggccaaggactg<br>gaatggatgggttggatctccgcctacaacggcaacactaactacgcccagaagctgcagggggaga<br>gtgaccatgacaactgacacctcgacctcaaccgcgtacatggaactgcgcagccttaggtccgac<br>gatacggcggtgtactattgtgcacgggccggcttggccctctactcgaactacgtgccctactac<br>tactacggaatggacgtctggggacagggaaccactgtgaccgtgtcctccgggggtggaggctca<br>ggcggaggaggaagcggcggggtggaagcaactttatgctgacccagcctcactcggtcggag<br>agccctggaaagactgtgaccatctcctgcactcggagctcgggctccattgcgtcaaactacgtg<br>cagtggtaccagcagcgccccggttcctcgccaaccaccgtgatctacgaggacaaccaacgcccg<br>tccggggtgcctgaccggttctccggctccatcgattcctcttccaactccgcttccctgaccatt<br>agcggcctcaagaccgaggatgaagccgactactactgccagtcctacgactcaagcaatccgtgg<br>gtgttcggtggaggaactaagctgaccgtgctcaccactacccagcaccgaggcgcacccaccccg<br>gctcctaccatcgcctcccagcctctgtccctgcgtccgaggcatgtagacccgcagctggtggg<br>gccgtgcatacccggggtcttgacttcgcctgcgatatctacatttgggcccctctggctggtact<br>tgcggggtcctgctgctttcactcgtgatcactctttactgtaagcgcggtcggaagaagctgctg<br>tacatctttaagcaaccttcatgaggcctgtgcagactactcagagaggaggacggctgttcatgc<br>cggttcccagaggaggaggaaggcggctgcgaactgcgcgtgaaattcagccgcagcgcagatgct<br>ccagcctacaagcaggggcagaaccagctctacaacgaactcaatcttggtcggagagaggagtac<br>gacgtgctggacaagcggagaggacgggacccagaaatgggcgggaagccgcgcagaaagaatccc<br>caagagggcctgtacaacgagctccaaaaggataagatggcagaagcctatagcgagattggtatg<br>aaaggggaacgcagaagaggcaaaggccacgacggactgtaccagggactcagcaccgccaccaag<br>gacacctatgacgctcttcacatgcaggccctgccgcctcgg |
| CAR22-9<br>scFv<br>AA | 250 | evqlvesgggglvkpggslrlscvasgftfsnawmnwvrqapgkglewvgrikskidggtadyaapv<br>kgrftisrddsknthmylqmnslktedtgvyycitgatdvwgqgttvtvssggggsggggsggggss<br>yvltqppsasgtpgqrvtiscsgsssnigsnyvywyqqlpgtapklliyrnnqrpsgvpdrfsgsk<br>sgtsaslaisglrsedeadyycaawddslsgpvfgggtkltvl |
| CAR22-9<br>scFv NT | 251 | gaagtgcagctcgtggaatcgggcggtggactggtcaagccaggaggttccctgcgcgtcgtcctgc<br>gtggcctccggtttcacattctccaacgcgtggatgaattgggtgcgccaagcccctggaaaggga<br>cttgaatgggtcggacggatcaagagcaaaaccgacggaggaactgccgattacgccgcaccgtg<br>aagggcagattcaccattcgcggggatgactcgaagaacaccatgtacctccagatgaactccctc<br>aagaccgaggataccgcgctctactactgcatcaccggcgctactgacgtctggggacagggaact<br>accgtgactgtgtcctccggcggaggcggaagcggaggagggggcagcggggcggggatcatcc<br>tacgtgctcactcagccgccttcagcctccggtacccgggccagcgcgtgaccatttcatgctcg<br>ggctcctcctcaaacatcgggagcaactacgtgtactggtaccagcagctgcccggtactgcccc<br>aagctgctgatctaccggaacaaccaacgcccgagcggagtgccggacagattctccgggtccaag |

TABLE 6A-continued

Human CD22 CAR Constructs

| Name | SEQ ID | Sequence |
|---|---|---|
| | | tctgggacctccgctagcctggcgatctccggtctgaggagcgaggacgaggcagactactattgt<br>gcggcctgggacgattccctgtcggggcctgtgtttggaggcggcacgaagttgaccgtgctg |
| CAR22-9 soluble scFV NT | 252 | atggccctccctgtcaccgccctgctgcttccgctggctcttctgctccacgccgctcggcccgaa<br>gtgcagctcgtggaatcgggcggtggactggtcaagccaggaggttccctgcggctgtcctgcgtg<br>gcctccggtttcacattctccaacgcgtggatgaattgggtgcgccaagcccctggaaagggactt<br>gaatgggtcggacggatcaagagcaaaaccgacggaggaactgccgattacgccgcacccgtgaag<br>ggcagattcaccatttcgcgggatgactcgaagaacaccatgtacctccagatgaactcgctcaag<br>accgaggataccggcgtctactactgcatcaccggcgctactgacgtctggggacagggaactacc<br>gtgactgtgtcctccggcggaggcggaagcggaggaggggggcagcggggcgggggatcatcctac<br>gtgctcactcagccgccttcagcctccggtacccccgggccagcgcgtgaccatttcatgctcggc<br>tcctcctcaaacatcgggagcaactacgtgtactggtaccagcagctgcccggtactgccccaag<br>ctgctgatctaccggaacaaccaacgcccgagcggagtgccggacagattctccgggtccaagtct<br>gggacctccgctagcctggcgatctccggtctgaggagcgaggacgaggcagactactattgtgcg<br>gcctgggacgattccctgtcggggcctgtgtttggaggcggcacgaagttgaccgtgctgggatcg<br>caccaccatcaccatcatcatcac |
| CAR22-9 soluble scFV AA | 253 | malpvtalllplalllhaarpevqlvesgggllvkpggslrlscvasgftfsnawmnwvrqapgkgl<br>ewvgrisktdggtadyaapvkgrftisrddskntmylqmnslktedtgvyycitgatdvwgqgtt<br>vtvssggggsggggsggggssyvltqppsasgtpgqrvtiscsgsssnigsnyvywyqqlpgtapk<br>lliyrnnqrpsgvpdrfsgsksgtsaslaisglrsedeadyycaawddslsgpvfgggtkltvlgs<br>hhhhhhhh |
| CAR22-9 Full AA | 254 | malpvtalllplalllhaarpevqlvesgggllvkpggslrlscvasgftfsnawmnwvrqapgkgl<br>ewvgrisktdggtadyaapvkgrftisrddskntmylqmnslktedtgvyycitgatdvwgqgtt<br>vtvssggggsggggsggggssyvltqppsasgtpgqrvtiscsgsssnigsnyvywyqqlpgtapk<br>lliyrnnqrpsgvpdrfsgsksgtsaslaisglrsedeadyycaawddslsgpvfgggtkltvltt<br>tpaprpptpaptiasqplslrpeacrpaaggavhtrgldfacdiyiwaplagtcgvlllslvitly<br>ckrgrkkllyifkqpfmrpvqttqeedgcscrfpeeeeggcelrvkfsrsadapaykqgqnqlyne<br>lnlgrreeydvldkrrgrdpemggkprrknpqeglynelqkdkmaeayseigmkgerrrgkghdgl<br>yqglstatkdtydalhmqalppr |
| CAR22-9 Full NT lentivirus | 255 | atggccctccctgtcaccgccctgctgcttccgctggctcttctgctccacgccgctcggcccgaa<br>gtgcagctcgtggaatcgggcggtggactggtcaagccaggaggttccctgcggctgtcctgcgtg<br>gcctccggtttcacattctccaacgcgtggatgaattgggtgcgccaagcccctggaaagggactt<br>gaatgggtcggacggatcaagagcaaaaccgacggaggaactgccgattacgccgcacccgtgaag<br>ggcagattcaccatttcgcgggatgactcgaagaacaccatgtacctccagatgaactcgctcaag<br>accgaggataccggcgtctactactgcatcaccggcgctactgacgtctggggacagggaactacc<br>gtgactgtgtcctccggcggaggcggaagcggaggaggggggcagcggggcgggggatcatcctac<br>gtgctcactcagccgccttcagcctccggtacccccgggccagcgcgtgaccatttcatgctcggc<br>tcctcctcaaacatcgggagcaactacgtgtactggtaccagcagctgcccggtactgccccaag<br>ctgctgatctaccggaacaaccaacgcccgagcggagtgccggacagattctccgggtccaagtct<br>gggacctccgctagcctggcgatctccggtctgaggagcgaggacgaggcagactactattgtgcg<br>gcctgggacgattccctgtcggggcctgtgtttggaggcggcacgaagttgaccgtgctgaccact<br>accccagcaccgaggccacccaccccggctcctaccatcgcctcccagcctctgtccctgcgtccg<br>gaggcatgtagaccccgcagctggtggggccgtgcataccgggtcttgacttcgcctgcgatatc<br>tacatttgggcccctctggctggtacttgcgggtcctgctgctttcactcgtgatcactcttttac<br>tgtaagcgcggtcggaagaagctgctgtacatcttttaagcaaccccttcatgaggcctgtgcagact<br>actcaagaggaggacggctgttcatgccggttcccagaggaggaggaaggcggctgcgaactgcgc<br>gtgaaattcagccgcagcgcagatgctccagcctgcaacagggcgcagaaccagctctacaacgaa<br>ctcaatcttggtcggagagaggagtacgacgtgctggacaggcggagaggacgggacccagaaatg<br>ggcgggaagccgcgcagaaagaatccccaagagggcctgtacaacgagctccaaaaggataagatg<br>gcagaagcctatagcgagattggtatgaaagggaacgcagaagaggcaaaggccacgacggactg<br>taccagggactcagcaccgccaccaaggacacctatgacgctcttcacatgcaggccctgccgcct<br>cgg |
| CAR22-10 scFv AA | 256 | evqlqqsgpglvkpsqtlsltcaisgdsvlsnsdtwnwirqspsrglewlgrtyhrstwyddyass<br>vrgrvsinvdtsknqyslqlnavtpedtgvyycardrlqdgnswsdafdvwgqgtmvtvssggggs<br>ggggsggggsqsaltqpasvsgspgqsitisctgtssdvggynynvswyqqhpgkapklmiydvsnr<br>psgvsnrfsgsksgntasltisglqaedeadyycssytssstlvyvfgtgtkvtvl |
| CAR22-10 scFv NT | 257 | gaagtgcagcttcagcagtctggtcccgggcttgtcaaaccatcgcagaccctgtccctgacttgc<br>gcgatcagcggcgatagcgtgctgtcaaactcggacacctggaactggatcaggcagtccccttcc<br>cgcggactggaatggttgggccggacgtaccatcgctccacttggtacgacgactatgccagctcc<br>gtgagaggccgggtgtcgatcaacgtggatacttcaaagaaccagtactccctccaactcaatgct<br>gtgaccccggaggacaccggagtgtactactgtgcccgggatagactgcaggacggaaactcatgg<br>agcgacgccttcgacgtgtggggacagggcaccatggtcaccgtgtccagcggtggagggaggctcc<br>ggcgtggaggttcgggggaggagggagccaatcggctctgacccaaccggcctcagtcagcggt<br>tcgcccggacagtccattactattagctgcaccggaacctccagcgacgtgggcggctacaactat<br>gtgtcgtggtaccagcagcacccggggaaggcccctaagctgatgatctacgacgtgtccaatcgg<br>ccctccggggtgtccaaccgcttctccggctcgaagtccggcaacactgcatcactgacaatcagc<br>ggactgcaagccgaggacgaagcggattactactgctcctcctacacctcctcctccactctcgtc<br>tacgtgtttggaaccgggaccaaggtcaccgtgctg |
| CAR22-10 soluble | 258 | atggccctccctgtcaccgccctgctgcttccgctggctcttctgctccacgccgctcggcccgaa<br>gtgcagcttcagcagtctggtcccgggcttgtcaaaccatcgcagaccctgtccctgacttgcgcg |

TABLE 6A-continued

Human CD22 CAR Constructs

| Name | SEQ ID | Sequence |
|---|---|---|
| scFV NT | | atcagcggcgatagcgtgctgtcaaactcggacacctggaactggatcaggcagtcccttcccgc<br>ggactggaatggttgggccggacgtaccatcgctccacttggtacgacgactatgccagctccgtg<br>agaggccgggtgtcgatcaacgtggatacttcaaagaaccagtactccctccaactcaatgctgtg<br>accccggaggacaccggagtgtactactgtgcccgggatagactgcaggacggaaaactcatggagc<br>gacgccttcgacgtgtggggacagggcaccatggtcaccgtctccagcggtggaggaggctccggc<br>ggtggaggttcggggggaggagggagccaatcggctctgacccaaccggcctcagtcagcggttcg<br>cccggacagtccattactattagctgcaccggaacctccagcgacgtgggcggctacaactatgtg<br>tcgtggtaccagcagcaccggggaaggcccctaagctgatgatctacgacgtgtccaatcggccc<br>tccggggtgtccaaccgcttctccggctcgaagtccggcaacactgcatcactgacaatcagcgga<br>ctgcaagccgaggacgaagcggattactactgctcctcctacacctcctcctccactctcgtctac<br>gtgtttggaaccgggaccaaggtcaccgtgctgggatcgcaccaccatcaccatcatcatcac |
| CAR22-10<br>soluble<br>scFV AA | 259 | malpvtalllplallllhaarpevqlqqsgpglvkpsqtlsltcaisgdsvlsnsdtwnwirqspsr<br>glewlgrtyhrstwyddyassvrgrvsinvdtsknqyslqlnavtpedtgvyycardrlqdgnsws<br>dafdvwgqgtmvtssgggsggggsggggsqsaltqpasvsgspgqsitisctgtssdvggynyv<br>swyqqhpgkapklmiydvsnrpsgvsnrfsgsksgntasltisglqaedeadyycssytssstlvy<br>vfgtgtkvtvlgshhhhhhhh |
| CAR22-10<br>Full AA | 260 | malpvtalllplallllhaarpevqlqqsgpglvkpsqtlsltcaisgdsvlsnsdtwnwirqspsr<br>glewlgrtyhrstwyddyassvrgrvsinvdtsknqyslqlnavtpedtgvyycardrlqdgnsws<br>dafdvwgqgtmvtssgggsggggsggggsqsaltqpasvsgspgqsitisctgtssdvggynyv<br>swyqqhpgkapklmiydvsnrpsgvsnrfsgsksgntasltisglqaedeadyycssytssstlvy<br>vfgtgtkvtvltttpaprpptpaptiasqplslrpeacrpaaggavhtrgldfacdiyiwaplagt<br>cgvllslvitlyckrgrkkllyifkqpfmrpvqttqeedgcscrfpeeeeggcelrvkfsrsada<br>paykqgqnqlynelnlgrreeydvldkrrgrdpemggkprrknpqeglynelqkdkmaeayseigm<br>kgerrrgkghdglyqglstatkdtydalhmqalppr |
| CAR22-10<br>Full NT<br>lentivirus | 261 | atggccctcctgtcaccgccctgctgcttccgctggctcttctgctccacgccgctcggcccgaa<br>gtgcagcttcagcagtctggtcccgggcttgtcaaaccatcgcagacccgtccctgacttgcgcg<br>atcagcggcgatagcgtgctgtcaaactcggacacctggaactggatcaggcagtcccttcccgc<br>ggactggaatggttgggccggacgtaccatcgctccacttggtacgacgactatgccagctccgtg<br>agaggccgggtgtcgatcaacgtggatacttcaaagaaccagtactccctccaactcaatgctgtg<br>accccggaggacaccggagtgtactactgtgcccgggatagactgcaggacggaaaactcatggagc<br>gacgccttcgacgtgtggggacagggcaccatggtcaccgtctccagcggtggaggaggctccggc<br>ggtggaggttcggggggaggagggagccaatcggctctgacccaaccggcctcagtcagcggttcg<br>cccggacagtccattactattagctgcaccggaacctccagcgacgtgggcggctacaactatgtg<br>tcgtggtaccagcagcaccggggaaggcccctaagctgatgatctacgacgtgtccaatcggccc<br>tccggggtgtccaaccgcttctccggctcgaagtccggcaacactgcatcactgacaatcagcgga<br>ctgcaagccgaggacgaagcggattactactgctcctcctacacctcctcctccactctcgtctac<br>gtgtttggaaccgggaccaaggtcaccgtgctgaccactaccccagcaccgaggccacccaccccg<br>gctcctaccatcgcctccagcctctgtccctgcgtccgaggcatgtagacccgcagctggtggg<br>gccgtgcataccggggtcttgacttcgcctgcgatatctacattttgggcccctctggctggtact<br>tgcgggtcctgctgctttcactcgtgatcactcttactgtaagcgcggtcggaagaagctgctg<br>tacatctttaagcaaccctttcatgaggcctgtgcagactactcaagaggaggacggctgttcatgc<br>cggttcccagaggaggaggaaggcggctgcgaactgcgcgtgaaattcagccgcagcgcagatgct<br>ccagcctacaagcaggggcagaaccagctctctacaacgaactcaatcttggtcggagagaggagtac<br>gacgtgctggacaagcggagaggacgggacccagaaatgggcgggaagccgcgcagaaagaatccc<br>caagagggcctgtacaacgagctccaaaaggataagatggcagaagcctatagcgagattggtatg<br>aaaggggaacgcagaagaggcaaaggccacgacggactgtaccagggactcagcaccgccaccaag<br>gacacctatgacgctcttcacatgcaggccctgccgcctcgg |
| CAR22-11<br>scFv<br>AA | 262 | evqlqqsgpglvkpsqtlsltcaisgdsvssnsaawnwirqspsrglewlgrtyyrskwyndyavs<br>vksritinpdtsknqfslqlnsvtpedtavyycareesssgwyegnwfdpwgqgtlvtvssggggs<br>ggggsggggssseltqdpavsvalgqtvritcqgdslrsyyaswyqqkpgqapvliygknhrpsg<br>ipdrfsgsssgdtdsltitgaqaedeadyychsrdssgnhlfgggtkltvl |
| CAR22-11<br>scFv NT | 263 | gaagtgcaacttcagcagtccggtcctggcttggtcaagccgtcacagaccctgtcgctgacttgt<br>gctattagcggggactctgtgtcctcaaactccgccgcatggaactggattagacagtcgccctcc<br>cggggactggagtggctgggccgcacctactaccggtccaagtggtacaatgactacgccgtgtcc<br>gtgaagtcccgcattactatcaaccccgacacttcgaagaaccagttttcgctgcaactcaactcc<br>gtcaccctgaggataccgccgtgtactattgcgcccgggaagaatcctccagcggttggtacgaa<br>ggaaactggttcgacccatggggccagggcaccctggtcactgtgtcctcggagggggggcagc<br>ggtggcggaggaagcggaggaggaggctccagctccgagctcacccaggacccggcggtgtcagtg<br>gccctgggccaaacggtccgcatcacatgccaggggattccctgaggtcatactacgcgagctgg<br>tatcagcagaaaccggacaagcccctgtgctcgtgatctacgggaagaaccacaggccgagcgga<br>atcccggatagattctccgggtcctcatcgggagacactgacagcctcaccatcaccggcgcgcag<br>gccgaggacgaagctgattactactgccattcccgggactcgagcgggaaccacctttcggtggc<br>ggaaccaagctgaccgtgctg |
| CAR22-11<br>soluble<br>scFV NT | 264 | atggccctcctgtcaccgccctgctgcttccgctggctcttctgctccacgccgctcggcccgaa<br>gtgcaacttcagcagtccggtcctggcttgtcaagccgtcacagaccctgtcgctgacttgtgct<br>attagcggggactctgtgtcctcaaactccgccgcatggaactggattagacagtcgccctcccgg<br>ggactggagtggctgggccgcacctactaccggtccaagtggtacaatgactacgccgtgtccgtg<br>aagtcccgcattactatcaaccccgacacttcgaagaaccagttttcgctgcaactcaactccgtc<br>acccctgaggataccgccgtgtactattgcgcccgggaagaatcctccagcggttggtacgaagga<br>aactggttcgacccatggggccagggcaccctggtcactgtgtcctcggagggggggcagcggt |

TABLE 6A-continued

Human CD22 CAR Constructs

| Name | SEQ ID | Sequence |
|------|--------|----------|
| | | ggcggaggaagcggaggaggaggctccagctccgagctcacccaggaccggcggtgtcagtggcc<br>ctgggccaaacggtccgcatcacatgccaggggattccctgaggtcatactacgcgagctggtat<br>cagcagaaacccggacaagcccctgtgctcgtgatctacgggaagaaccacaggccgagcggaatc<br>ccggatagattctccggtcctcatcgggagacactgacagcctcaccatcaccggcgcgcaggcc<br>gaggacgaagctgattactactgccattcccgggactcgagcgggaaccaccttttcggtggcgga<br>accaagctgaccgtgctggatcgcaccaccatcaccatcatcatcac |
| CAR22-11 soluble scFV AA | 265 | malpvtalllplalllhaarpevqlqqsgpglvkpsqtlsltcaisgdsvssnsaawnwirqspsr<br>glewlgrtyyrskwyndyavsvksritinpdtsknqfslqlnsvtpedtavyycareessssgwyeg<br>nwfdpwgqgtlvtvssggggsggggsggggssseltqdpavsvalgqtvritcqgdslrsyyaswy<br>qqkpgqapvlviygknhrpsgipdrfsgsssgdtdsltitgaqaedeadyychsrdssgnhlfggg<br>tkltvlgshhhhhhhh |
| CAR22-11 Full AA | 266 | malpvtalllplalllhaarpevqlqqsgpglvkpsqtlsltcaisgdsvssnsaawnwirqspsr<br>glewlgrtyyrskwyndyavsvksritinpdtsknqfslqlnsvtpedtavyycareessssgwyeg<br>nwfdpwgqgtlvtvssggggsggggsggggssseltqdpavsvalgqtvritcqgdslrsyyaswy<br>qqkpgqapvlviygknhrpsgipdrfsgsssgdtdsltitgaqaedeadyychsrdssgnhlfggg<br>tkltvltttpaprpptpaptiasqplslrpeacrpaaggavhtrgldfacdiyiwaplagtcgvll<br>lslvitlyckrgrkkllyifkqpfmrpvqttqeedgcscrfpeeeeggcelrvkfsrsadapaykq<br>gqnqlynelnlgrreeydvldkrrgrdpemggkprrknpqeglynelqkdkmaeayseigmkgerr<br>rgkghdglyqglstatkdtydalhmqalppr |
| CAR22-11 Full NT lentivirus | 267 | atggccctccctgtcaccgccctgctgcttccgctggctcttctgctccacgccgctcggcccgaa<br>gtgcaacttcagcagtccggtcctggcttggtcaagccgtcacagaccctgtcgctgacttgtgct<br>attagcggggactctgtgtcctcaaactccgccgcatggaactggattagacagtcgccctcccgg<br>ggactggagtggctgggccgcacctactaccggtccaagtggtacaatgactacgccgtgtccgtg<br>aagtcccgcattactataaccccgacacttcgaagaaccagttttcgctgcaactcaactccgtc<br>acccctgaggataccgccgtgtactattgcgcccgggaagaatcctccagcggttggtacgaagga<br>aactggttcgacccatggggccagggcaccctggtcactgtgtcctcggggaggaggggcagcggt<br>ggcggaggaagcggaggaggaggctccagctccgagctcacccaggaccggcggtgtcagtggcc<br>ctgggccaaacggtccgcatcacatgccaggggattccctgaggtcatactacgcgagctggtat<br>cagcagaaacccggacaagcccctgtgctcgtgatctacgggaagaaccacaggccgagcggaatc<br>ccggatagattctccggtcctcatcgggagacactgacagcctcaccatcaccggcgcgcaggcc<br>gaggacgaagctgattactactgccattcccgggactcgagcgggaaccaccttttcggtggcgga<br>accaagctgaccgtgctgaccactaccccagcaccgaggccacccacccggctcctaccatcgcc<br>tcccagcctctgtccctgcgtccgaggcatgtagacccgcagctggtggggccgtgcatacccgg<br>ggtcttgacttcgcctgcgatatctacatttgggcccctctggctggtacttgcggggtcctgctg<br>ctttcactcgtgatcactctttactgtaagcgcggtcggaagaagctgctgtacatctcttaagcaa<br>cccttcatgaggcctgtgcagactactcaagaggaggacggcgttcatgccggttcccagaggag<br>gaggaaggcggctgcgaactgcgcgtgaaattcagccgcagcgcagatgctccagcctacaagcag<br>gggcagaaccagctctacaacgaactcaatcttggtcggagagaggagtacgacgtgctggacaag<br>cggagaggacgggacccagaaatgggcgggaaggccgcgcagaaagaaatcccaagagggcctgtac<br>aacgagctccaaaaggataagatggcagaagcctatagcgagattggtatgaaagggaacgcaga<br>agaggcaaaggccacgacggactgtaccagggactcagcaccgccaccaaggacacctatgacgct<br>cttcacatgcaggccctgccgcctcgg |
| CAR22-12 scFv AA | 268 | evqlqqsgpglvkpsqtlsltcaisgdsvlsnsdtwnwirqspsrglewlgrtyhrstwyddyass<br>vrgrvsinvdtsknqyslqlnavtpedtgvyycardrlqdgnswsdafdvwgqgtmvtvssggggs<br>ggggsggggsqsaltqpasasgspgqsvtisctgtssdvggynyvswyqqhpgkapklmiydvsnr<br>psgvsnrfsgsksgntasltisglqaedeadyycssytssstlyvfgtgtqltvl |
| CAR22-12 scFv NT | 269 | gaagtgcagctgcagcagagcggaccgggcctggtcaaaccctcccaaaccctgtccctcacttgc<br>gcgatctccggggactccgtgctctcgaactccgacacctggaactggattcggcagagccatcg<br>aggggcctggaatggctgggaagaacctaccaccggtccacttggtacgatgactacgcgagctca<br>gtgcgcggacgcgtgtcgattaacgtggacacctccaagaaccagtacagcttgcaactgaacgcc<br>gtgacccctgaggacaccggagtgtactattgcgcccgggatagacttcaggacggaaacagctgg<br>tccgacgcctttgacgtctggggacagggcaccatggtcactgtgtcctcggtggcggggggtcc<br>ggtggaggaggttcaggcggaggcggctcacagtcagcactgacgcagccggcttccgcttccggg<br>agccctggacagagcgtgaccatctcgtgtaccgggacttccagcgatgtcggcgggtacaactac<br>gtgtcttggtaccaacagcatccgggaaaggcccccaagtcatgatctacgacgtgtcaaaccgg<br>cccagcggagtgtccaatcgcttctccggctccaagtcgggcaatactgcctcgctgactatcagc<br>ggtctgcaagccgaagatgaggccgactattactgctcctcctacacctcgtcctccacactctac<br>gtgttcggaaccggtactcagctgaccgtgctt |
| CAR22-12 soluble scFV NT | 270 | atggccctccctgtcaccgccctgctgcttccgctggctcttctgctccacgccgctcggcccgaa<br>gtgcagctgcagcagagcggaccgggcctggtcaaaccctcccaaaccctgtccctcacttgcgcg<br>atctccggggactccgtgctctcgaactccgacacctggaactggattcggcagagccatcgagg<br>ggcctggaatggctgggaagaacctaccaccggtccacttggtacgatgactacgcgagctcagtg<br>cgcggacgcgtgtcgattaacgtggacacctccaagaaccagtacagcttgcaactgaacgccgtg<br>acccctgaggacaccggagtgtactattgcgcccgggatagacttcaggacggaaacagctgg<br>tccgacgcctttgacgtctggggacagggcaccatggtcactgtgtcctcggtggcggggggtccggt<br>ggaggaggttcaggcggaggcggctcacagtcagcactgacgcagccggcttccgcttccgggagc<br>cctggacagagcgtgaccatctcgtgtaccgggacttccagcgatgtcggcgggtacaactacgtg<br>tcttggtaccaacagcatccgggaaaggcccccaagtcatgatctacgacgtgtcaaaccggccc<br>agcggagtgtccaatcgcttctccggctccaagtcgggcaatactgcctcgctgactatcagcggt |

TABLE 6A-continued

Human CD22 CAR Constructs

| Name | SEQ ID | Sequence |
|---|---|---|
| | | ctgcaagccgaagatgaggccgactattactgctcctcctacacctcgtcctccacactctacgtg<br>ttcggaaccggtactcagctgaccgtgcttggatcgcaccaccatcaccatcatcatcac |
| CAR22-12<br>soluble<br>scFV AA | 271 | malpvtalllplalllhaarpevqlqqsgpglvkpsqtlsltcaisgdsvlsnsdtwnwirqspsr<br>glewlgrtyhrstwyddyassvrgrvsinvdtsknqyslqlnavtpedtgvyycardrlqdgnsws<br>dafdvwgqgtmvtvssggggsggggsggggsqsaltqpasasgspgqsvtisctgtssdvggynyv<br>swyqqhpgkapklmiydvsnrpsgvsnrfsgsksgntasltisglqaededadyycssytssstlyv<br>fgtgtqltvlgshhhhhh |
| CAR22-12<br>Full AA | 272 | malpvtalllplalllhaarpevqlqqsgpglvkpsqtlsltcaisgdsvlsnsdtwnwirqspsr<br>glewlgrtyhrstwyddyassvrgrvsinvdtsknqyslqlnavtpedtgvyycardrlqdgnsws<br>dafdvwgqgtmvtvssggggsggggsggggsqsaltqpasasgspgqsvtisctgtssdvggynyv<br>swyqqhpgkapklmiydvsnrpsgvsnrfsgsksgntasltisglqaededadyycssytssstlyv<br>fgtgtqltvltttpaprrpptpaptiasqplslrpeacrpaaggavhtrgldfacdiyiwaplagtc<br>gvllllslvitlyckrgrkkllyifkqpfmrpvqttqeedgcscrfpeeeeggcelrvkfsrsadap<br>aykqgqnqlynelnlgrreeydvldkrrgrdpemggkpprknpqeglynelqkdkmaeaysei gmk<br>gerrrgkghdglyqglstatkdtydalhmqalppr |
| CAR22-12<br>Full NT<br>lentivirus | 273 | atggccctccctgtcaccgccctgctgcttccgctggctcttctgctccacgccgctcggcccgaa<br>gtgcagctgcagcagagcggaccgggcctggtcaaacctcccaaacctgtccctcacttgcgcg<br>atctccggggactccgtgctctcgaactccgacacctggaactggattcggcagagccccatcgagg<br>ggcctggaatggctgggaagaacctaccaccggtccacttggtacgatgactacgcgagctcagtg<br>cgcggacgcgtgtcgattaacgtggacacctccaagaaccagtacagcttgcaactgaacgccgtg<br>acccctgaggacaccggagtgtactattgcgcccgggatagacttcaggacggaaacagctggtcc<br>gacgcctttgacgtctgggacagggcaccatggtcactgtgtcctcgggtggcggggggtccggt<br>ggaggaggttcaggcggaggcggctcacagtcagcactgacgcagccggcttccgcttccgggagc<br>cctggacagagcgtgaccatctcgtgtaccgggacttccagcgatgtcggcgggtacaactacgtg<br>tcttggtaccaacagcatccgggaaaggcccccaagctcatgatctacgacgtgtcaaaccggccc<br>agcggagtgtccaatcgcttctccggctccaagtcgggcaatactgcctcgctgactatcagcggt<br>ctgcaagccgaagatgaggccgactattactgctcctcctacacctcgtcctccacactctacgtg<br>ttcggaaccggtactcagctgaccgtgcttaccactaccccagcaccgaggccaccccacccggct<br>cctaccatcgcctccagcctctgtccctgcgtccggaggcatgtagacccgcagctggtggggcc<br>gtgcatacccggggtcttgacttcgcctgcgatatctacatttgggccctctggctggtacttgc<br>ggggtcctgctgcttcactcgtgatcactctttactgtaagcgcggtcggaagaagctgctgtac<br>atctttaagcaaccccttcatgaggcctgtgcagactactcaagaggaggacggctgttcatgccgg<br>ttcccagaggaggaggaaggcggctgcgaactgcgcgtgaaattcagccgcagcgcagatgctcca<br>gcctacaagcaggggcagaaccagctctacaacgaactcaatcttggtcggagagaggagtacgac<br>gtgctggacaagcggagaggacgggacccagaaatgggcgggaagccgcgcagaaagaatcccaa<br>gagggcctgtacaacgagctccaaaaggataagatggcagaagcctatagcgagattggtatgaaa<br>ggggaacgcagaagaggcaaaggccacgacggactgtaccagggactcagcaccgccaccaaggac<br>acctatgacgctcttcacatgcaggccctgccgcctcgg |
| CAR22-13<br>scFv<br>AA | 274 | qvqlqesgpglvkpsetlsltctvsggsissssyywgwirqppgkglewigsiyysgstyynpslk<br>srvtisvdtsknqfslklssvtaadtavyycargrmdtamaqiwgqgtmvtvssgdggsggggsgg<br>ggsnfmltqphsvsespgktvtipctgssgsfassyvqwyqqrpgsapatviyednqrpsgvpdrf<br>sgsvdsssnsasltisglktedeavyycqsydgatwvfgggtkltvl |
| CAR22-13<br>scFv NT | 275 | caagtgcagctccaagaatcaggtcccggcctcgtgaagccttccgaaaccctctcccttacttgt<br>accgtgtccggggggaagcatctcgagcagctcctattactggggatggatcaggcagcctcccgga<br>aagggactggagtggattggctccatctactactcggggtccacctactacaacccgtcactgaagt<br>ccccgcgtgaccatctcggtggatacctccaagaaccagttcagcctgaagctgtcctccgtgact<br>gccgccgacactgccgtgtactactgcgcgcgggtcggatggacacagcgatggctcagatttgg<br>ggacagggcaccatggtcactgtgtcctccggggatggaggctccggggcggaggatctggtggc<br>gggggtcgaacttcatgttgacccagccacactccgtgtcggaaagcccaggaaagaccgtcacc<br>atcccttgcactggaagcagcggttcgttcgcatcaagctacgtgcagtggtaccagcaaagaccc<br>ggcagcgctccggccaccgtcatctatgaggacaatcagcggccgtccggcgtgccggaccgcttc<br>agcggatcggtggactcatcctcaaactccgcctccctgacgatttccggtctgaaaaccgaggac<br>gaagccgtctactactgccagtcgtacgatggcgccacttgggtgtttggaggaggcaccaagctg<br>accgtgctg |
| CAR22-13<br>soluble<br>scFV NT | 276 | atggccctccctgtcaccgccctgctgcttccgctggctcttctgctccacgccgctcggcccgaa<br>gtgcagctccaagaatcaggtcccggcctcgtgaagccttccgaaaccctctcccttacttgtacc<br>gtgtccggggggaagcatctcgagcagctcctattactggggatggatcaggcagcctcccgaaag<br>ggactggagtggattggctccatctactactcggggtccacctactacaacccgtcactgaagtcc<br>cgcgtgaccatctcggtggatacctccaagaaccagttcagcctgaagctgtcctccgtgactgcc<br>gccgacactgccgtgtactactgcgcgcgggtcggatggacacagcgatggctcagatttggggga<br>cagggcaccatggtcactgtgtcctccggggatggaggctccggggcggaggatctggtggcggg<br>ggtcgaacttcatgttgacccagccacactccgtgtcggaaagcccaggaaagaccgtcaccatc<br>ccttgcactggaagcagcggttcgttcgcatcaagctacgtgcagtggtaccagcaaagacccggc<br>agcgctccggccaccgtcatctatgaggacaatcagcggccgtccggcgtgccggaccgcttcagc<br>ggatcggtggactcatcctcaaactccgcctccctgacgatttccggtctgaaaaccgaggacgaa<br>gccgtctactactgccagtcgtacgatggcgccacttgggtgtttggaggaggcaccaagctgacc<br>gtgctgggatcgcaccaccatcaccatcatcatcac |
| CAR22-13<br>soluble | 277 | malpvtalllplalllhaarpqvqlqesgpglvkpsetlsltctvsggsissssyywgwirqppgk<br>glewigsiyysgstyynpslksrvtisvdtsknqfslklssvtaadtavyycargrmdtamaqiwg |

TABLE 6A-continued

Human CD22 CAR Constructs

| Name | SEQ ID | Sequence |
| --- | --- | --- |
| scFV AA | | qgtmvtvssgdggsgggsggggsnfmltqphsvsespgktvtipctgssgsfassyvqwyqqrpg<br>sapatviyednqrpsgvpdrfsgsvdsssnsasltisglktedeavyycqsydgatwvfgggtklt<br>vlgshhhhhhhh |
| CAR22-13<br>Full AA | 278 | malpvtalllplalllhaarpqvqlqesgpglvkpsetlsltctvsggsissssyywgwirqppgk<br>glewigsiyysgstyynpslksrvtisvdtsknqfslklssvtaadtavyycargrmdtamaqiwg<br>qgtmvtvssgdggsgggsggggsnfmltqphsvsespgktvtipctgssgsfassyvqwyqqrpg<br>sapatviyednqrpsgvpdrfsgsvdsssnsasltisglktedeavyycqsydgatwvfgggtklt<br>vltttpaprpptpaptiasqplslrpeacrpaaggavhtrgldfacdiyiwaplagtcgvlllslv<br>itlyckrgrkkllyifkqpfmrpvqttqeedgcscrfpeeeeggcelrvkfsrsadapaykqgqnq<br>lynelnlgrreeydvldkrrgrdpemggkpprrknpqeglynelqkdkmaeayseigmkgerrrgkg<br>hdglyqglstatkdtydalhmqalppr |
| CAR22-13<br>Full NT | 279 | atggccctccctgtcaccgccctgctgcttccgctggctcttctgctccacgccgctcggcccaa<br>gtgcagctccaagaatcaggtcccggcctcgtgaagcttccgaaaccctctcccttacttgtacc<br>gtgtccgggggaagcatctcgagcagctcctattactggggatggatcaggcagcctcccggaaag<br>ggactggagtggattggctccatctactactcggggtccactactacaacccgtcactgaagtcc<br>cgcgtgaccatctcggtggatacctccaagaaccagttcagcctgaagctgtcctccgtgactgcc<br>gccgacactgccgtgtactactgcgcgcggggtcggatggacacagcgatggctcagatttgggga<br>cagggcaccatggtcactgtgtcctccggggatggaggctccgggggcggaggatctggtggcggg<br>gggtcgaacttcatgttgacccagccacactccgtgtccgaaagcccaggaaagaccgtcaccatc<br>ccttgcactggaagcagcggttcgttcgcatcaagctacgtgcagtggtaccagcaaagaccgcc<br>agcgctccggccaccgtcatctatgaggacaatcagcggccgtccggcgtgccggaccgcttcagc<br>ggatcggtggactcatcctcaaactccgcctccctgacgatttccggtctgaaaaccgaggacgaa<br>gccgctctactactgccagtcgtacgatggcgccacttgggtgtttggaggaggcaccaagctgacc<br>gtgctgaccactaccccagcaccgaggccaccccaccccggctcctaccatcgcctcccagcctctg<br>tccctgcgtccggaggcatgtagacccgcagctggtggggccgtgcataccgggggtcttgacttc<br>gcctgcgatatctacatttgggcccctctggctggtacttgcggggtcctgctgctttcactcgtg<br>atcactctttactgtaagcgcggtcggaagaagctgctgtacatctttaagcaaccctt catgagg<br>cctgtgcagactactcaagaggaggacggctgttcatgccggtccccagaggaggaggaggcggc<br>tgcgaactgcgcgtgaaattcagccgcagcgcagatgctccagcctacaagcaggggcagaaccag<br>ctctacaacgaactcaatcttggtcggagagaggagtacgacgtgctggacaagcggagaggacgg<br>gacccagaaatgggcggaagccgcgcagaaagaatccccaagagggcctgtacaacgagctccaa<br>aaggataagatggcagaagcctatagcgagattggtatgaaaggggaacgcagaagaggcaaaggc<br>cacgacggactgtaccagggactcagcaccgccaccaaggacacctatgacgctcttcacatgcag<br>gccctgccgcctcgg |
| CAR22-14<br>scFv<br>AA | 280 | qvqlvqsgaevkkpgasvkvsckasgytftsyymhwvrqapgqglewmgiinpsggstsyaqkfqg<br>rvtmtrdtststvymelsslrsedtavyycardldvsldiwgqgtmvtvssggggsggggsggggs<br>qsaltqpasvsgspgqsitiscsgtssdvggynsvswyqqypgkapklmiydvnnrpsgvssrfsg<br>sksgntasltisglqaededayycssytssstlffgagtkvtvl |
| CAR22-14<br>scFv NT | 281 | caagtgcaacttgtccagagcggagcagaagtcaagaaaccaggagcaagcgtgaaggtgtcctgc<br>aaagcgtcaggctacactttcacctcctactatatgcactgggtccgccaggcccctggacaaggc<br>ctggaatggatgggtatcatcaacccgtccggtggaagcaccagctacgcccagaagtttcaggga<br>agagtgaccatgactcgggacactt caacctcgacggtgtacatggagctgtcctccctgcggtcg<br>gaggacaccgccgtgtactactgcgcgagggatctcgatgtgtccctggacatttggggacagggc<br>accatggtcaccgtgtcctccgggggggcggatcaggcggcggaggttcaggggcggggctcc<br>cagtccgcgctgactcagccggctagcgtgtccggctcgccgggacagagcattaccatctcgtgc<br>tcgggtaccagctccgacgtgggaggctataactccgtgtcctggtaccagcagtaccccggaaag<br>gccccaagctgatgatctacgacgtgaacaatcgcccttctggggtgtcctctcggttctccggg<br>tcaaagagcggaaacaccgctccctgaccatctcgggactccaagctgaggatgaagccgactac<br>tactgttcgagctacacctcctcctccactctcttcttcggtgccggaactaaggtcacagtgttg |
| CAR22-14<br>soluble<br>scFV NT | 282 | atggccctccctgtcaccgccctgctgcttccgctggctcttctgctccacgccgctcggcccaa<br>gtgcaacttgtccagagcggagcagaagtcaagaaaccaggagcaagcgtgaaggtgtcctgcaaa<br>gcgtcaggctacactttcacctcctactatatgcactgggtccgccaggcccctggacaaggcctg<br>gaatggatgggtatcatcaacccgtccggtggaagcaccagctacgcccagaagtttcagggaaga<br>gtgaccatgactcgggacacttcaacctcgacggtgtacatggagctgtcctccctgcgtcggag<br>gacaccgccgtgtactactgcgcgagggatctcgatgtgtccctggacatttggggacagggcacc<br>atggtcaccgtgtcctccggggggggcggatcaggcggcggaggttcaggggcggggctcccag<br>tccgcgctgactcagccggctagcgtgtccggctcgccgggacagagcattaccatctcgtgctcg<br>ggtaccagctccgacgtgggaggctataactccgtgtcctggtaccagcagtaccccggaaaggcc<br>cccaagctgatgatctacgacgtgaacaatcgcccttctggggtgtcctctcggttctccgggtca<br>aagagcggaaacaccgctccctgaccatctcgggactccaagctgaggatgaagccgactactac<br>tgttcgagctacacctcctcctccactctcttcttcggtgccggaactaaggtcacagtgttggga<br>tcgcaccaccatcaccatcatcatcac |
| CAR22-14<br>soluble<br>scFV AA | 283 | malpvtalllplalllhaarpqvqlvqsgaevkkpgasvkvsckasgytftsyymhwvrqapgqgl<br>ewmgiinpsggstsyaqkfqgrvtmtrdtststvymelsslrsedtavyycardldvsldiwgqgt<br>mvtvssggggsggggsggggsqsaltqpasvsgspgqsitiscsgtssdvggynsvswyqqypgka<br>pklmiydvnnrpsgvssrfsgsksgntasltisglqaededayycssytssstlffgagtkvtvlg<br>shhhhhhhh |
| CAR22-14<br>Full AA | 284 | malpvtalllplalllhaarpqvqlvqsgaevkkpgasvkvsckasgytftsyymhwvrqapgql<br>ewmgiinpsggstsyaqkfqgrvtmtrdtststvymelsslrsedtavyycardldvsldiwgqgt |

TABLE 6A-continued

Human CD22 CAR Constructs

| Name | SEQ ID | Sequence |
|---|---|---|
| | | mvtvssggggsggggsggggsqsaltqpasvsgspgqsitiscsgtssdvggynsvswyqqypgka
pklmiydvnnrpsgvssrfsgsksgntasltisglqaededadyycssytsssstlffgagtkvtvlt
ttpaprpptpaptiasqplslrpeacrpaaggavhtrgldfacdiyiwaplagtcgvlllslvitl
yckrgrkkllyifkqpfmrpvqttqeedgcscrfpeeeeggcelrvkfsrsadapaykqgqnqlyn
elnlgrreeydvldkrrgrdpemggkprrknpqeglynelqkdkmaeayseigmkgerrrgkghdg
lyqglstatkdtydalhmqalppr |
| CAR22-14 Full NT | 285 | atggccctccctgtcaccgccctgctgcttccgctggctcttctgctccacgccgctcggccccaa
gtgcaacttgtccagagcggagcagaagtcaagaaaccaggagcaagcgtgaaggtgtcctgcaaa
gcgtcaggctacactttcacctcctactatatgcactgggtccgccaggcccctggacaaggcctg
gaatggatgggtatcatcaacccgtccggtggaagcaccagctacgcccagaagtttcagggaaga
gtgaccatgactcgggacacttcaacctcgacggtgtacatggagctgtcctccctgcggtcggag
gacaccgccgtgtactactgcgcgagggatctcgatgtgtccctggacatttggggacagggcacc
atggtcaccgtgtcctccgggggggcggatcaggcggcggaggttcaggggcggggctcccag
tccgcgctgactcagccggctagcgtgtccggctcgccgggacagagcattaccatctcgtgctcg
ggtaccagctccgacgtgggaggctataactccgtgtcctggtaccagcagtaccccggaaaggcc
cccaagctgatgatctacgacgtgaacaatcgccttctgggtgtcctctcggttctccgggtca
aagagcggaaacaccgctccctgaccatctcgggactccaagctgaggatgaagccgactactac
tgttcgagctacacctcctcctccactctcttcttcggtgccggaactaaggtcacagtgttgacc
actaccccagcaccgaggcaccaccccggctcctaccatcgcctcccagcctctgtccctgcgt
ccggaggcatgtagacccgcagctggtggggccgtgcatacccgggtcttgacttcgcctgcgat
atctacatttgggcccctctggctggtacttgcggggtcctgctgctttcactcgtgatcactctt
tactgtaagcgcggtcggaagaagctgctgtacatctttaagcaaccttcatgaggcctgtgcag
actactcaagaggaggacgctgttcatgccggttcccagaggaggaggaaggcggctgcgaactg
cgcgtgaaattcagccgcagcgcagatgctccagcctacaagcaggggcagaaccagctctacaac
gaactcaatcttggtggagagaaggagtacgacgtgctggacaagcggagaggacgggacccagaa
atgggcgggaagccgcgcagaaagaatccccaagagggcctgtacaacgagctccaaaaggataag
atggcagaagcctatagcgagattggtatgaaagggaacgcagaagaggcaaaggccacgacgga
ctgtaccagggactcagcaccgccaccaaggacacctatgacgctcttcacatgcaggccctgccg
cctcgg |
| CAR22-15 scFv AA | 286 | evqlvesggglvqpggslrlscaasgftfssyamhwvrqapgkgleyvsaissnggstyyansvkd
rftisrdnskntlylqmgslraedmavyycarvhssgyyhpgpndywgqgtlvtvssggggsgggg
sggggssseltqdpavsvalgqtvritcqgdslrtyyatwyqqkpgqapvlvfydennrpsgipdr
fsgsssgntasltitgtqaededadyycssrdssgnpscvfgggtkltvl |
| CAR22-15 scFv NT | 287 | gaagtgcagttggtggagagcggtggaggacttgtgcaacctggaggatcattgagactgtcgtgt
gcggcctccggctttacctctcgtcctacgctatgcattgggtccgccaggcccccgggaaagga
ctcgaatacgtcagcgccatctcctcaaacgggggatcaacctactacgccaattccgtgaaggat
cggttcaccatctcccgggataacagcaagaacaccctgtatctgcaaatggggtccctgagggca
gaggacatggccgtctactactgcgcgcgcgtgcacagctctggatactaccaccctggaccgaac
gattactgggggccagggcactctcgtgaccgtgtcctcgggggggtggtggaagcggcggcggagga
tcgggggggaggcggctcctcgagcgaactgacacaggaccctgccgtgtccgtggctctgggtcag
actgtgcgcattacgtgtcaaggagactccctgagaacttattacgcgacctggtaccagcagaag
ccgggacaggcaccggtgctggtgttctacgacgaaaacaaccggccatccgggattcccgaccgg
ttctccggctcatcgagcggcaacactgcctccctgaccatcaccgggacccaggccgaggacgag
gccgattactactgctcctcgcgggactcctccggcaaccccctcctgcgtgttcggcggtggaacc
aagctgactgtcctc |
| CAR22-15 soluble scFV NT | 288 | atggccctccctgtcaccgccctgctgcttccgctggctcttctgctccacgccgctcggcccgaa
gtgcagttggtggagagcggtggaggacttgtgcaacctggaggatcattgagactgtcgtgtgcg
gcctccggctttacctctcgtcctacgctatgcattgggtccgccaggcccccgggaaaggactc
gaatacgtcagcgccatctcctcaaacgggggatcaacctactacgccaattccgtgaaggatcgg
ttcaccatctcccgggataacagcaagaacaccctgtatctgcaaatggggtccctgagggcagag
gacatggccgtctactactgcgcgcgcgtgcacagctctggatactaccaccctggaccgaacgat
tactgggggccagggcactctcgtgaccgtgtcctcgggggggtggtggaagcggcggcggaggatcg
ggggggaggcggctcctcgagcgaactgacacaggaccctgccgtgtccgtggctctgggtcagact
gtgcgcattacgtgtcaaggagactccctgagaacttattacgcgacctggtaccagcagaagccg
ggacaggcaccggtgctggtgttctacgacgaaaacaaccggccatccgggattcccgaccggttc
tccggctcatcgagcggcaacactgcctccctgaccatcaccgggacccaggccgaggacgagcc
gattactactgctcctcgcgggactcctccggcaaccccctcctgcgtgttcggcggtggaaccaag
ctgactgtcctcggatcgcaccaccatcaccatcatcac |
| CAR22-15 soluble scFV AA | 289 | malpvtalllplalllhaarpevqlvesggglvqpggslrlscaasgftfssyamhwvrqapgkgl
eyvsaissnggstyyansvkdrftisrdnskntlylqmgslraedmavyycarvhssgyyhpgpnd
ywgqgtlvtvssggggsggggsggggssseltqdpavsvalgqtvritcqgdslrtyyatwyqqkp
gqapvlvfydennrpsgipdrfsgsssgntasltitgtqaededadyycssrdssgnpscvfgggtk
ltvlgshhhhhhhh |
| CAR22-15 Full AA | 290 | malpvtalllplalllhaarpevqlvesggglvqpggslrlscaasgftfssyamhwvrqapgkgl
eyvsaissnggstyyansvkdrftisrdnskntlylqmgslraedmavyycarvhssgyyhpgpnd
ywgqgtlvtvssggggsggggsggggssseltqdpavsvalgqtvritcqgdslrtyyatwyqqkp
gqapvlvfydennrpsgipdrfsgsssgntasltitgtqaededadyycssrdssgnpscvfgggtk
ltvltttpaprpptpaptiasqplslrpeacrpaaggavhtrgldfacdiyiwaplagtcgvllls
lvitlyckrgrkkllyifkqpfmrpvqttqeedgcscrfpeeeeggcelrvkfsrsadapaykqgq |

TABLE 6A-continued

Human CD22 CAR Constructs

| Name | SEQ ID | Sequence |
|---|---|---|
| | | nqlynelnlgrreeydvldkrrgrdpemggkpprrknpqeglynelqkdkmaeayseigmkgerrrg kghdglyqglstatkdtydalhmqalppr |
| CAR22-15 Full NT | 291 | atggccctccctgtcaccgccctgctgcttccgctggctcttctgctccacgccgctcggcccgaa gtgcagttggtggagagcggtggaggacttgtgcaacctggaggatcattgagactgtcgtgtgcg gcctccggctttaccttctcgtcctacgctatgcattgggtccgccaggcccccgggaaaggactc gaatacgtcagcgccatctcctcaaacggggatcaacctactacgccaattccgtgaaggatcgg ttcaccatctcccgggataacagcaagaacaccctgtatctgcaaatggggtccctgagggcagag gacatggccgtctactactgcgcgcgcgtgcacagctctggatactaccaccctggaccgaacgat tactggggccagggcactctcgtgaccgtgtcctcggggggtggtggaagcggcggcggaggatcg ggggaggcggctcctcgagcgaactgacacaggaccctgccgtgtccgtggctctgggtcagact gtgcgcattacgtgtcaaggagactccctgagaacttattacgcgacctggtaccagcagaagccg ggacaggcaccggtgctggtgttctacgacgaaaacaaccggccatccgggattcccgaccggttc tccggctcatcgagcggcaacactgcctccctgaccatcaccggggacccaggccgaggacgaggcc gattactactgctcctcgcggggactcctcggcaaccctcctgcgtgttcggcggtggaaccaag ctgactgtcctcaccactaccccagcaccgaggccacccaccccggctcctaccatcgcctcccag cctctgtccctgcgtccggaggcatgtagaccccgcagctggtggggcctggcatacccggggtctt gacttcgcctgcgatatctacatttgggcccctctggctggtacttgcggggtcctgctgctttca ctcgtgatcactctttactgtaagcgcggtcggaagaagctgctgtacatctttaagcaaccctttc atgaggcctgtgcagactactcaagaggaggacggctgttcatgccggttcccagaggaggaggaa ggcggctgcgaactgcgcgtgaaattcagccgcagcgcagatgctccagcctacaagcagggggcag aaccagctctacaacgaactcaatcttggtcggagagaggagtacgacgtgctggacaagcggaga ggacgggacccagaaatgggcgggaagccgcgcagaaagaatccccaagagggcctgtacaacgag ctccaaaaggataagatggcagaagcctatagcgagattggtatgaaagggggaacgcagaagaggc aaaggccacgacggactgtaccagggactcagcaccgccaccaaggacacctatgacgctcttcac atgcaggccctgccgcctcgg |
| CAR22-16 scFv AA | 292 | evqlvesgaevkkpgasvkvsckasgytftsyymhwvrqapgqglewmgiinpsggstsyaqkfqg rvtmtrdtststaymelsslrsedtavyycareagvvavdywgqgtlvtvssggggsggggsgggg sqsaltqpasvsgspgqsitisctgtssdvggynyvswyqqhpgkapklmiydvsnrpsgvsnrfs gsksgntasltisglqaedeadyycssytssstwvfgggtkltvl |
| CAR22-16 scFv NT | 293 | gaagtgcaactcgtcgaatctggagcggaagtcaagaagcctggagcaagcgtgaaagtgtcctgt aaagcgtccggttacaccttcacttcgtattacatgcactgggtccgccaagctccgggacagggga ctggaatggatgggcatcatcaaccctagcggaggatcgacctcctacgcccaaaagttccagggc agagtgaccatgacccgggacaccagcacatcaactgcctacatggagctgtcatcactgaggtcc gaggataccgccgtgtactattgcgcccgcgaggccggcgtggtggccgtcgactactggggacag ggcactctcgtgaccgtgtcatcgggaggcggcggttccggggggggaaggtcggggggcggaggc tcccagtccgcactgacgcagccggcttccgtgtctggttcgcccggacagtccatcaccatttcc tgcactggaaccagcagcgacgtgggcggttacaactacgtgtcatggtaccagcagcatcccgga aaggcccaaagcttatgatctacgacgtgtccaatcggcgtcgggcgtcagcaaccggttctcc ggctccaagtccgggaacactgccagcctgaccattagcgggctgcaggccgaggacgaagcggat tactactgctcctcctacttcctcctcgacctgggtgtttggtggaggcaccaagttgactgtg ctg |
| CAR22-16 soluble scFV NT | 294 | atggccctccctgtcaccgccctgctgcttccgctggctcttctgctccacgccgctcggcccgaa gtgcaactcgtcgaatctggagcggaagtcaagaagcctggagcaagcgtgaaagtgtcctgtaaa gcgtccggttacaccttcacttcgtattacatgcactgggtccgccaagctccgggacagggactg gaatggatgggcatcatcaaccctagcggaggatcgacctcctacgcccaaaagttccagggcaga gtgaccatgacccgggacaccagcacatcaactgcctacatggagctgtcatcactgaggtccgag gataccgccgtgtactattgcgcccgcgaggccggcgtggtggccgtcgactactggggacagggc actctcgtgaccgtgtcatcgggaggcggcggttccggggggggaggtcggggggcggaggctcc cagtccgcactgacgcagccggcttccgtgtctggttcgcccggacagtccatcaccatttcctgc actggaaccagcagcgacgtgggcggttacaactacgtgtcatggtaccagcagcatcccggaaag gcccaaagcttatgatctacgacgtgtccaatcggccgtcgggcgtcagcaaccggttctccgga tccaagtccgggaacactgccagcctgaccattagcgggctgcaggccgaggacgaagcggattac tactgctcctcctacttcctcctcgacctgggtgtttggtggaggcaccaagttgactgtgctg ggatcgcaccaccatcaccatcatcac |
| CAR22-16 soluble scFV AA | 295 | malpvtalllplalllhaarpevqlvesgaevkkpgasvkvsckasgytftsyymhwvrqapgqgl ewmgiinpsggstsyaqkfqgrvtmtrdtststaymelsslrsedtavyycareagvvavdywgqg tlvtvssggggsggggsggggsqsaltqpasvsgspgqsitisctgtssdvggynyvswyqqhpgk apklmiydvsnrpsgvsnrfsgsksgntasltisglqaedeadyycssytssstwvfgggtkltvl gshhhhhhhh |
| CAR22-16 Full AA | 296 | malpvtalllplalllhaarpevqlvesgaevkkpgasvkvsckasgytftsyymhwvrqapgqgl ewmgiinpsggstsyaqkfqgrvtmtrdtststaymelsslrsedtavyycareagvvavdywgqg tlvtvssggggsggggsggggsqsaltqpasvsgspgqsitisctgtssdvggynyvswyqqhpgk apklmiydvsnrpsgvsnrfsgsksgntasltisglqaedeadyycssytssstwvfgggtkltvl tttpaprrpptpaptiasqplslrpeacrpaaggavhtrgldfacdiyiwaplagtcgvlllslvit lyckrgrkkllyifkqpfmrpvqttqeedgcscrfpeeeeggcelrvkfsrsadapaykqgqnqly nelnlgrreeydvldkrrgrdpemggkpprrknpqeglynelqkdkmaeayseigmkgerrrgkghd glyqglstatkdtydalhmqalppr |
| CAR22-16 Full NT | 297 | atggccctccctgtcaccgccctgctgcttccgctggctcttctgctccacgccgctcggcccgaa gtgcaactcgtcgaatctggagcggaagtcaagaagcctggagcaagcgtgaaagtgtcctgtaaa |

TABLE 6A-continued

Human CD22 CAR Constructs

| Name | SEQ ID | Sequence |
|---|---|---|
| | | gcgtccggttacaccttcacttcgtattacatgcactgggtccgccaagctccgggacagggactg
gaatggatgggcatcatcaaccctagcggaggatcgacctcctacgcccaaaagttccagggcaga
gtgaccatgacccgggacaccagcacatcaactgcctacatggagctgtcatcactgaggtccgag
gataccgccgtgtactattgcgcccgcgaggccggcgtggtggccgtcgactactggggacagggc
actctcgtgaccgtgtcatcgggaggcggcggttccggggggggaggtcggggggcggaggctcc
cagtccgcactgacgcagccggcttccgtgtctggttcgccccggacagtccatcaccatttcctgc
actggaaccagcagcgacgtgggcggttacaactacgtgtcatggtaccagcagcatcccggaaag
gccccaaagcttatgatctacgacgtgtcaatcggccgtcgggcgtcagcaaccggttctccggc
tccaagtccgggaacactgccagcctgaccattagcgggctgcaggccgaggacgaagcggattac
tactgctcctcctacacttcctcctcgacctgggtgtttggtggaggcaccaagttgactgtgctg
accactaccccagcaccgaggccacccaccccggctcctaccatcgcctcccagcctctgtccctg
cgtccggaggcatgtagacccgcagctggtggggcctgtgcatacccggggtcttgacttcgcctgc
gatatctacatttgggcccctctggctgtactgcggggtcctgctgctttcactcgtgatcact
ctttactgtaagcgcggtcggaagaagtgctgtacatctttaagcaaccttcatgaggcctgtg
cagactactcaagaggaggacggctgttcatgccggttcccagaggaggaggaaggcggctgcgaa
ctgcgcgtgaaattcagccgcagcgcagatgctccagcctacaagcaggggcagaaccagctctac
aacgaactcaatcttggtcggagaggagtacgacgtgctggacaagcggagagacgggaccca
gaaatgggcgggaagccgcgcagaaagaatcccaagagggcctgtacaacgagctccaaaaggat
aagatggcagaagcctatagcgagattggtatgaaaggggaacgcagaagaggcaaaggccacgac
ggactgtaccagggactcagcaccgccaccaaggacacctatgacgctcttcacatgcaggccctg
ccgcctcgg |
| CAR22-17<br>scFv<br>AA | 298 | qvqlvqsggggvvqpgrslrlscaasgftfssyamswvrqapgkglewvsaisgsgggstyyadsvkg
rftisrdnskntlylqmnslraedtavyycakeplfgvveedvdywgqgtlvtvssggggsggggs
ggggsdvvmtqsplslpvtpgepasiscrssqsllagnhnyldwylqkpgqspqlliylgsnras
gvpdrfsgsgsgtdftlkisrveaedvgvyycmqalqnpltfgggtkleikr |
| CAR22-17<br>scFv NT | 299 | caagtgcagttggtccagagcggaggaggagtggtgcaacccggaagatcattgaggctctcatgt
gctgcaagcggattcaccttctcgagctacgcaatgtcctgggtgcgccaggcccctggaaaggga
ctggaatgggtgtccgccatctcgggctccggcggatcaacgtactacgccgactccgtgaagggc
cgctttactatttcaagagacaactccaagaacactctgtacctccaaatgaactctctgcgggcc
gaggacaccgccgtgtactactgcgcgaaggagccgctgttcggcgtggtggaggaagatgtggac
tactggggccagggcactctcgtcaccgtgtcctccggcggtggaggatcggggaggcggaggcagc
ggggtggtggctccgacgtcgtgatgaccagtcgcccctgtccctgcccgtgaccccttgggggaa
ccggcctccatttcctgccggtccagccagtcgctgctggctggaaacggacacaattaccttgat
tggtatctgcaaaagcctgggcagtcaccgcagctgctgatctacctcggaagcaacccgggcgtcc
ggggtgccggaccggttctccggttccgggagcggcaccgacttcaccctgaaaatctcgagggtg
gaggccgaagatgtcggagtgtactattgcatgcaggcgcttcagaacccactcactttcgggggc
ggtactaagctggaaatcaagcgc |
| CAR22-17<br>soluble<br>scFV NT | 300 | atggcccctcctgtcaccgccctgctgcttccgctggctcttctgctccacgccgctcggccccaa
gtgcagttggtccagagcggaggaggagtggtgcaacccggaagatcattgaggctctcatgtgct
gcaagcggattcaccttctcgagctacgcaatgtcctgggtgcgccaggcccctggaaagggactg
gaatgggtgtccgccatctcgggctccggcggatcaacgtactacgccgactccgtgaagggccgc
tttactatttcaagagacaactccaagaacactctgtacctccaaatgaactctctgcgggccgag
gacaccgccgtgtactactgcgcgaaggagccgctgttcggcgtggtggaggaagatgtggactac
tggggccagggcactctcgtcaccgtgtcctccggcggtggaggatcggggaggcggaggcagcggg
ggtggtggctccgacgtcgtgatgaccagtcgcccctgtccctgcccgtgaccccggggaaccg
gcctccatttcctgccggtccagccagtcgctgctggctggaaacggacacaattaccttgattgg
tatctgcaaaagcctgggcagtcaccgcagctgctgatctacctcggaagcaacccgggcgtccgg
gtgccggaccggttctccggttccgggagcggcaccgacttcaccctgaaaatctcgagggtggag
gccgaagatgtcggagtgtactattgcatgcaggcgcttcagaacccactcactttcgggggcggt
actaagctggaaatcaagcgcggatcgcaccaccatcaccatcatcac |
| CAR22-17<br>soluble<br>scFV AA | 301 | malpvtalllplalllhaarpqvqlvqsggggvvqpgrslrlscaasgftfssyamswvrqapgkgl
ewvsaisgsgggstyyadsvkgrftisrdnskntlylqmnslraedtavyycakeplfgvveedvdy
wgqgtlvtvssggggsggggsggggsdvvmtqsplslpvtpgepasiscrssqsllagnhnyldw
ylqkpgqspqlliylgsnrasgvpdrfsgsgsgtdftlkisrveaedvgvyycmqalqnpltfggg
tkleikrgshhhhhhh |
| CAR22-17<br>Full AA | 302 | malpvtalllplalllhaarpqvqlvqsggggvvqpgrslrlscaasgftfssyamswvrqapgkgl
ewvsaisgsgggstyyadsvkgrftisrdnskntlylqmnslraedtavyycakeplfgvveedvdy
wgqgtlvtvssggggsggggsggggsdvvmtqsplslpvtpgepasiscrssqsllagnhnyldw
ylqkpgqspqlliylgsnrasgvpdrfsgsgsgtdftlkisrveaedvgvyycmqalqnpltfggg
tkleikrttttpaprrpptpaptiasqplslrpeacrpaaggavhtrgldfacdiyiwaplagtcgvl
llslvitlyckrgrkkllyifkqpfmrpvqttqeedgcscrfpeeeeggcelrvkfsrsadapayk
qgqnqlynelnlgrreeydvldkrrgrdpemggkprrknpqeglynelqkdkmaeayseigmkger
rrgkghdglyqglstatkdtydalhmqalppr |
| CAR22-17<br>Full NT | 303 | atggcccctcctgtcaccgccctgctgcttccgctggctcttctgctccacgccgctcggccccaa
gtgcagttggtccagagcggaggaggagtggtgcaacccggaagatcattgaggctctcatgtgct
gcaagcggattcaccttctcgagctacgcaatgtcctgggtgcgccaggcccctggaaagggactg
gaatgggtgtccgccatctcgggctccggcggatcaacgtactacgccgactccgtgaagggccgc
tttactatttcaagagacaactccaagaacactctgtacctccaaatgaactctctgcgggccgag
gacaccgccgtgtactactgcgcgaaggagccgctgttcggcgtggtggaggaagatgtggactac
tggggccagggcactctcgtcaccgtgtcctccggcggtggaggatcggggaggcggaggcagcggg |

TABLE 6A-continued

Human CD22 CAR Constructs

| Name | SEQ ID | Sequence |
|---|---|---|
| | | ggtggtggctccgacgtcgtgatgacccagtcgcccctgtccctgcccgtgaccctggggaaccg |
| | | gcctccatttcctgccggtccagccagtcgctgctggctggaaacggacacaattaccttgattgg |
| | | tatctgcaaaagcctgggcagtcaccgcagctgctgatctacctcggaagcaacggcgtccggg |
| | | gtgccggaccggttctccggttccgggagcggcaccgacttcaccctgaaaatctcgagggtggag |
| | | gccgaagatgtcggagtgtactattgcatgcaggcgcttcagaaccccactcactttcggggggt |
| | | actaagctggaaatcaagcgcaccactacccagcaccgaggccaccacccgggcctctaccatc |
| | | gcctcccagcctctgtccctgcgtccggaggcatgtagacccgcagctggtgggggccgtgcatacc |
| | | cggggtcttgacttcgcctgcgatatctacatttgggcccctctggctggtacttgcggggtcctg |
| | | ctgctttcactcgtgatcactctttactgtaagcgcggtcggaagaagctgctgtacatcttttaag |
| | | caaccccttcatgaggcctgtgcagactactcaagaggaggacggctgttcatgccggttcccagag |
| | | gaggaggaaggcggctgcgaactgcgcgtgaaattcagccgcagcgcagatgctccagcctacaag |
| | | caggggcagaaccagctctacaacgaactcaatcttggtcggagagaggagtacgacgtgctggac |
| | | aagcggagaggacgggacccagaaatgggcgggaagccgcgcagaaagaatccccaagagggcctg |
| | | tacaacgagctccaaaaggataagatggcagaagcctatagcgagattggtatgaaaggggaacgc |
| | | agaagaggcaaaggccacgacggactgtaccaggggactcagcaccgccaccaaggacacctatgac |
| | | gctcttcacatgcaggccctgccgcctcgg |
| CAR22-18 scFv AA | 304 | qvqlvqsgaevkkpgasvkvsckasgytftsyymhwvrqapgqglewmgiinpsgggstsyaqkfqg rvtmtrdtststvymelsslrsedtavyycargsgslgdafdiwgqgtmvtvssggggsggggsgg ggsqsaltqpasvsgspgqsitisctgsssdvggynyvswyqqhpgkapklmiyevsnrpsgvsnr fsgsksgntasltisglqaedeadyycssytsssltvfgtgtkvtvl |
| CAR22-18 scFv NT | 305 | caagtccaactcgtccaaagcggagctgaagtcaagaagcctggagcgtcagtgaaagtgtcctgc aaggcctccggctacacgtttacttcctactacatgcattgggtgcggcaggccccaggtcaagga ctggaatggatgggcatcattaaccttccgggggggtccaccttcgtatgcgcagaagttccaggc agagtgaccatgacccgcgacacctccacctccactgtgtacatggaactgtccagcctgaggtct gaggacactgccgtgtactactgtgcgcgcggtagcggatcactgggcgatgccttcgacatctgg ggccagggaactatggtcaccgtgtcctccggggggagggggctcgggtggaggaggttcaggcgga ggaggctcccagagcgcattgacacagcccgcttcggtgtccggctcccgggacagtccattacc atctcgtgcaccggaagctcaagcgatgtcggagggtacaactacgtgtcgtggtatcagcagcac ccgggaaaggcccccaagctcatgatctacgaagtgtccaatcggccgtccggggtgtcgaaccgg ttcagcggttccaagtcgggcaacactgccagcctgaccatcagcgggctgcaggccgaggacgag gccgactactactgctcctcgtacacctcctcctcaaccctggtgttcggcactggaactaaggtc accgtgctt |
| CAR22-18 soluble scFV NT | 306 | atggccctccctgtcaccgccctgctgcttccgctggctcttctgctccacgccgctcggccccaa gtccaactcgtccaaagcggagctgaagtcaagaagcctggagcgtcagtgaaagtgtcctgcaag gcctccggctacacgttttacttcctactacatgcattgggtgcggcaggcccccaggtcaaggactg gaatggatgggcatcattaaccttccgggggggtccaccttcgtatgcgcagaagttccaggcaga gtgaccatgacccgcgacacctccacctccactgtgtacatggaactgtccagcctgaggtctgag gacactgccgtgtactactgtgcgcgcggtagcggatcactgggcgatgccttcgacatctgggggc cagggaactatggtcaccgtgtcctccggggggagggggctcgggtggaggaggttcaggcggagga ggctcccagagcgcattgacacagcccgcttcggtgtccggctcccgggacagtccattaccatc tcgtgcaccggaagctcaagcgatgtcggagggtacaactacgtgtcgtggtatcagcagcacccg ggaaaggcccccaagctcatgatctacgaagtgtccaatcggccgtccggggtgtcgaaccggttc agcggttccaagtcgggcaacactgccagcctgaccatcagcgggctgcaggccgaggacgaggcc gactactactgctcctcgtacacctcctcctcaaccctggtgttcggcactggaactaaggtcacc gtgcttggatcgcaccaccatcaccatcatcac |
| CAR22-18 soluble scFV AA | 307 | malpvtalllplalllhaarpqvqlvqsgaevkkpgasvkvsckasgytftsyymhwvrqapgqgl ewmgiinpsgggstsyaqkfqgrvtmtrdtststvymelsslrsedtavyycargsgslgdafdiwg qgtmvtvssggggsggggsggggsqsaltqpasvsgspgqsitisctgsssdvggynyvswyqqhp gkapklmiyevsnrpsgvsnrfsgsksgntasltisglqaedeadyycssytsssltvfgtgtkvt vlgshhhhhhhh |
| CAR22-18 Full AA | 308 | malpvtalllplalllhaarpqvqlvqsgaevkkpgasvkvsckasgytftsyymhwvrqapgqgl ewmgiinpsgggstsyaqkfqgrvtmtrdtststvymelsslrsedtavyycargsgslgdafdiwg qgtmvtvssggggsggggsggggsqsaltqpasvsgspgqsitisctgsssdvggynyvswyqqhp gkapklmiyevsnrpsgvsnrfsgsksgntasltisglqaedeadyycssytsssltvfgtgtkvt vltttpaprppptpaptiasqplslrpeacrpaaggavhtrgldfacdiyiwaplagtcgvlllslv itlyckrgrkkllyifkqpfmrpvqttqeedgcscrfpeeeeggcelrvkfsrsadapaykqgqnq lynelnlgrreeydvldkrrgrdpemggkprrknpqeglynelqkdkmaeayseigmkgerrrgkg hdglyqglstatkdtydalhmqalppr |
| CAR22-18 Full NT | 309 | atggccctccctgtcaccgccctgctgcttccgctggctcttctgctccacgccgctcggccccaa gtccaactcgtccaaagcggagctgaagtcaagaagcctggagcgtcagtgaaagtgtcctgcaag gcctccggctacacgttttacttcctactacatgcattgggtgcggcaggcccccaggtcaaggactg gaatggatgggcatcattaaccttccgggggggtccaccttcgtatgcgcagaagttccaggcaga gtgaccatgacccgcgacacctccacctccactgtgtacatggaactgtccagcctgaggtctgag gacactgccgtgtactactgtgcgcgcggtagcggatcactgggcgatgccttcgacatctgggggc cagggaactatggtcaccgtgtcctccggggggagggggctcgggtggaggaggttcaggcggagga ggctcccagagcgcattgacacagcccgcttcggtgtccggctcccgggacagtccattaccatc tcgtgcaccggaagctcaagcgatgtcggagggtacaactacgtgtcgtggtatcagcagcacccg ggaaaggcccccaagctcatgatctacgaagtgtccaatcggccgtccggggtgtcgaaccggttc agcggttccaagtcgggcaacactgccagcctgaccatcagcgggctgcaggccgaggacgaggcc gactactactgctcctcgtacacctcctcctcaaccctggtgttcggcactggaactaaggtcacc |

TABLE 6A-continued

Human CD22 CAR Constructs

| Name | SEQ ID | Sequence |
|---|---|---|
| | | gtgcttaccactacccagcaccgaggccacccaccccggctcctaccatcgcctcccagcctctg<br>tccctgcgtccggaggcatgtagacccgcagctggtggggccgtgcatacccggggtcttgacttc<br>gcctgcgatatctacatttgggcccctctggctggtacttgcggggtcctgctgctttcactcgtg<br>atcactctttactgtaagcgcggtcggaagaagctgctgtacatctttaagcaaccctttcatgagg<br>cctgtgcagactactcaagaggaggacggctgttcatgccggttcccagaggaggaggaagggc<br>tgcgaactgcgcgtgaaattcagccgcagcgcagatgctccagcctacaagcaggggcagaaccag<br>ctctacaacgaactcaatcttggtcggagagaggagtacgacgtgctggacaagcggagaggacgg<br>gacccagaaatgggcgggaagccgcgcagaaagaatccccaagagggcctgtacaacgagctccaa<br>aaggataagatggcagaagcctatagcgagatggtatgaaaggggaacgcagaagaggcaaaggc<br>cacgacggactgtaccagggactcagcaccgccaccaaggacacctatgacgctcttcacatgcag<br>gccctgccgcctcgg |
| CAR22-19<br>scFv<br>AA | 310 | qvqlvqsgaevkkpgasvkvsckasgytftsyymhwvrqapgqglewmgiinpsggstsyaqkfqg<br>rvtmtrdtststvymelsslrsedtavyycardgfgelsgafdiwgqgtmvtvssggggsggggsg<br>gggsqsaltqpasvsgspgqsitisctgtssdvggynyvswyqqhpgkapklmiydvsnrpsgvsn<br>rfsgsksgntasltisglqaedeadyycssyasssstlvfgggtkvtvl |
| CAR22-19<br>scFv NT | 311 | caagtgcaactcgtccagtccggtgcagaagtcaagaaacccggagcctccgtgaaagtgtcctgc<br>aaggcctccggctacacgttcacttcatactacatgcactgggtccgccaggcgcccggacaggga<br>ctggagtggatgggcatcatcaaccctccggcggctcgacctcctacgcccaaaagttccaggga<br>agagtgacaatgaccagggatacttcaaccagcactgtctacatggaactgtctagcttgcggtcc<br>gaggacactgccgtgtactattgcgctcgggacggtttcggggagctgtccggggcctttgacatc<br>tggggccaggggactatggtgaccgtgtcctcggcggaggcggcagcggaggaggaggttcggga<br>ggcggaggaagccagtcagcactgacccagccagcctcggtgtccgggagcccgggccagagcatc<br>actatttcctgtaccgggacctcctccgacgtgggagggtacaattacgtgtcatggtatcaacag<br>catccgggaaaggcgccgaagctgatgatctacgacgtgtcgaaccgcccctagcggagtgtccaac<br>cggttctccggttcgaagtccgggaacaccgcgagcctgaccattagcggactccaggccgaggat<br>gaagccgactactactgctcctcctacgcttcatcgtccaccctggtgttcggtggtggcaccaag<br>gtcaccgtgctt |
| CAR22-19<br>soluble<br>scFV NT | 312 | atggccctccctgtcaccgccctgctgcttccgctggctcttctgctccacgccgctcggccccaa<br>gtgcaactcgtccagtccggtgcagaagtcaagaaacccggagcctccgtgaaagtgtcctgcaag<br>gcctccggctacacgttcacttcatactacatgcactgggtccgccaggcgcccggacagggactg<br>gagtggatgggcatcatcaaccctccggcggctcgacctcctacgcccaaaagttccagggaaga<br>gtgacaatgaccagggatacttcaaccagcactgtctacatggaactgtctagcttgcggtccgag<br>gacactgccgtgtactattgcgctcgggacggtttcggggagctgtccggggcctttgacatctgg<br>ggccaggggactatggtgaccgtgtcctcggcggaggcggcagcggaggaggaggttcgggaggc<br>ggaggaagccagtcagcactgacccagccagcctcggtgtccgggagcccgggccagagcatcact<br>atttcctgtaccgggacctcctccgacgtgggagggtacaattacgtgtcatggtatcaacagcat<br>ccgggaaaggcgccgaagctgatgatctacgacgtgtcgaaccgcccctagcggagtgtccaaccgg<br>ttctccggttcgaagtccgggaacaccgcgagcctgaccattagcggactccaggccgaggatgaa<br>gccgactactactgctcctcctacgcttcatcgtccaccctggtgttcggtggtggcaccaaggtc<br>accgtgcttggatcgcaccaccatcaccatcatcatcac |
| CAR22-19<br>soluble<br>scFV AA | 313 | malpvtalllplalllhaarpqvqlvqsgaevkkpgasvkvsckasgytftsyymhwvrqapgqgl<br>ewmgiinpsggstsyaqkfqgrvtmtrdtststvymelsslrsedtavyycardgfgelsgafdiw<br>gqgtmvtvssggggsggggsggggsqsaltqpasvsgspgqsitisctgtssdvggynyvswyqqh<br>pgkapklmiydvsnrpsgvsnrfsgsksgntasltisglqaedeadyycssyasssstlvfgggtkv<br>tvlgshhhhhhhh |
| CAR22-19<br>Full AA | 314 | malpvtalllplalllhaarpqvqlvqsgaevkkpgasvkvsckasgytftsyymhwvrqapgqgl<br>ewmgiinpsggstsyaqkfqgrvtmtrdtststvymelsslrsedtavyycardgfgelsgafdiw<br>gqgtmvtvssggggsggggsggggsqsaltqpasvsgspgqsitisctgtssdvggynyvswyqqh<br>pgkapklmiydvsnrpsgvsnrfsgsksgntasltisglqaedeadyycssyasssstlvfgggtkv<br>tvltttpaprppptpaptiasqplslrpeacrpaaggavhtrgldfacdiyiwaplagtcgvlllsl<br>vitlyckrgrkkllyifkqpfmrpvqttqeedgcscrfpeeeeggcelrvkfsrsadapaykqgqn<br>qlynelnlgrreeydvldkrrgrdpemggkprrknpqeglynelqkdkmaeayseigmkgerrrgk<br>ghdglyqglstatkdtydalhmqalppr |
| CAR22-19<br>Full NT | 315 | atggccctccctgtcaccgccctgctgcttccgctggctcttctgctccacgccgctcggccccaa<br>gtgcaactcgtccagtccggtgcagaagtcaagaaacccggagcctccgtgaaagtgtcctgcaag<br>gcctccggctacacgttcacttcatactacatgcactgggtccgccaggcgcccggacagggactg<br>gagtggatgggcatcatcaaccctccggcggctcgacctcctacgcccaaaagttccagggaaga<br>gtgacaatgaccagggatacttcaaccagcactgtctacatggaactgtctagcttgcggtccgag<br>gacactgccgtgtactattgcgctcgggacggtttcggggagctgtccggggcctttgacatctgg<br>ggccaggggactatggtgaccgtgtcctcggcggaggcggcagcggaggaggaggttcgggaggc<br>ggaggaagccagtcagcactgacccagccagcctcggtgtccgggagcccgggccagagcatcact<br>atttcctgtaccgggacctcctccgacgtgggagggtacaattacgtgtcatggtatcaacagcat<br>ccgggaaaggcgccgaagctgatgatctacgacgtgtcgaaccgcccctagcggagtgtccaaccgg<br>ttctccggttcgaagtccgggaacaccgcgagcctgaccattagcggactccaggccgaggatgaa<br>gccgactactactgctcctcctacgcttcatcgtccaccctggtgttcggtggtggcaccaaggtc<br>accgtgcttaccactacccagcaccgaggccacccaccccggctcctaccatcgcctcccagcct<br>ctgtccctgcgtccggaggcatgtagacccgcagctggtggggccgtgcatacccggggtcttgac<br>ttcgcctgcgatatctacatttgggcccctctggctggtacttgcggggtcctgctgctttcactc<br>gtgatcactctttactgtaagcgcggtcggaagaagctgctgtacatctttaagcaaccctttcatg<br>aggcctgtgcagactactcaagaggaggacggctgttcatgccggttcccagaggaggaggaaggc |

TABLE 6A-continued

Human CD22 CAR Constructs

| Name | SEQ ID | Sequence |
|---|---|---|
| | | ggctgcgaactgcgcgtgaaattcagccgcagcgcagatgctccagcctacaagcaggggcagaac<br>cagctctacaacgaactcaatcttggtcggagagaggagtacgacgtgctggacaagcggagagga<br>cgggacccagaaatgggcgggaagccgcgcagaaagaatccccaagagggcctgtacaacgagctc<br>caaaaggataagatggcagaagcctatagcgagattggtatgaaaggggaacgcagaagaggcaaa<br>ggccacgacggactgtaccagggactcagcaccgccaccaaggacacctatgacgctcttcacatg<br>caggccctgccgcctcgg |
| CAR22-20<br>scFv<br>AA | 316 | evqlvesgaevkkpgasvkvsckasgytftsyymhwvrqapgqglewmgiinpsggstsyaqkfqg<br>rvtmtrdtststvymelsslrsedtavyycargpigcsggscldywgqgtlvtvssggggsggggs<br>ggggsqsaltqpayvsgspgqsitisctgtnsdvgrynyvswyqqhpgkapklmiyevsyrpsgvs<br>nrfsgsksgntasltisglqaedeadyycssyttsstldfgtgtkvtvl |
| CAR22-20<br>scFv NT | 317 | gaagtgcaactcgtcgaatcaggagcagaagtcaagaaaccaggagcctccgtgaaagtcagctgc<br>aaggcctcgggctacacttttcacttcctactacatgcattgggtgcgccaggcccccgggccaggga<br>ctggaatggatgggcatcatcaatccctcgggaggttccactagctacgcgcagaagttccaggga<br>agagtgaccatgaccagagacacctcgacttcgacggtgtacatggagctgagctccctgaggagc<br>gaggacactgccgtgtactactgcgcccgggggcccgatcggatgcagcggggggtcctgtctcgat<br>tactggggccagggcacactcgtgaccgtgtccagcggggggcggtggtagcggaggagggggatcg<br>ggcggtggaggatcgcagtccgccctgacccaaccggcgtacgtgtctggatcacccggacagtcc<br>attaccatctcctgcaccggaaccaactcggacgtgggccgctacaactacgtgtcatggtaccag<br>cagcaccccgggaaggctcctaagctgatgatctacgaggtgtcctatcggcctagcggtgtcagc<br>aaccggttctccggctccaagtccggcaacactgcttcccttaccatttccgggttgcaagccgag<br>gacgaggccgattactactgttcctcctataccacttcatccaccctggactttggaaccggcacc<br>aaggtcaccgtgctg |
| CAR22-20<br>soluble<br>scFV NT | 318 | atggccctccctgtcaccgccctgctgcttccgctggctcttctgctccacgccgctcggcccgaa<br>gtgcaactcgtcgaatcaggagcagaagtcaagaaaccaggagcctccgtgaaagtcagctgcaag<br>gcctcgggctacacttttcacttcctactacatgcattgggtgcgccaggcccccgggccagggactg<br>gaatggatgggcatcatcaatccctcgggaggttccactagctacgcgcagaagttccaggaaga<br>gtgaccatgaccagagacacctcgacttcgacggtgtacatggagctgagctccctgaggagcgag<br>gacactgccgtgtactactgcgcccgggggcccgatcggatgcagcggggggtcctgtctcgattac<br>tggggccagggcacactcgtgaccgtgtccagcggggggcggtggtagcggaggagggggatcgggc<br>ggtggaggatcgcagtccgccctgacccaaccggcgtacgtgtctggatcacccggacagtccatt<br>accatctcctgcaccggaaccaactcggacgtgggccgctacaactacgtgtcatggtaccagcag<br>caccccgggaaggctcctaagctgatgatctacgaggtgtcctatcggcctagcggtgtcagcaac<br>cggttctccggctccaagtccggcaacactgcttcccttaccatttccgggttgcaagccgaggac<br>gaggccgattactactgttcctcctataccacttcatccaccctggactttggaaccggcaccaag<br>gtcaccgtgctgggatcgcaccaccatcaccatcatcatcac |
| CAR22-20<br>soluble<br>scFV AA | 319 | malpvtalllplalllhaarpevqlvesgaevkkpgasvkvsckasgytftsyymhwvrqapgqgl<br>ewmgiinpsggstsyaqkfqgrvtmtrdtststvymelsslrsedtavyycargpigcsggscldy<br>wgqgtlvtvssggggsggggsggggsqsaltqpayvsgspgqsitisctgtnsdvgrynyvswyqq<br>hpgkapklmiyevsyrpsgvsnrfsgsksgntasltisglqaedeadyycssyttsstldfgtgtk<br>vtvlgshhhhhhhh |
| CAR22-20<br>Full AA | 320 | malpvtalllplalllhaarpevqlvesgaevkkpgasvkvsckasgytftsyymhwvrqapgqgl<br>ewmgiinpsggstsyaqkfqgrvtmtrdtststvymelsslrsedtavyycargpigcsggscldy<br>wgqgtlvtvssggggsggggsggggsqsaltqpayvsgspgqsitisctgtnsdvgrynyvswyqq<br>hpgkapklmiyevsyrpsgvsnrfsgsksgntasltisglqaedeadyycssyttsstldfgtgtk<br>vtvltttpaprpptpaptiasgqplslrpeacrpaaggavhtrgldfacdiyiwaplagtcgvllls<br>lvitlyckrgrkkllyifkqpfmrpvqttqeedgcscrfpeeeeggcelrvkfsrsadapaykqgq<br>nqlynelnlgrreeydvldkrrgrdpemggkprrknpqeglynelqkdkmaeayseigmkgerrrg<br>kghdglyqglstatkdtydalhmqalppr |
| CAR22-20<br>Full NT | 321 | atggccctccctgtcaccgccctgctgcttccgctggctcttctgctccacgccgctcggcccgaa<br>gtgcaactcgtcgaatcaggagcagaagtcaagaaaccaggagcctccgtgaaagtcagctgcaag<br>gcctcgggctacacttttcacttcctactacatgcattgggtgcgccaggcccccgggccagggactg<br>gaatggatgggcatcatcaatccctcgggaggttccactagctacgcgcagaagttccaggaaga<br>gtgaccatgaccagagacacctcgacttcgacggtgtacatggagctgagctccctgaggagcgag<br>gacactgccgtgtactactgcgcccgggggcccgatcggatgcagcggggggtcctgtctcgattac<br>tggggccagggcacactcgtgaccgtgtccagcggggggcggtggtagcggaggagggggatcgggc<br>ggtggaggatcgcagtccgccctgacccaaccggcgtacgtgtctggatcacccggacagtccatt<br>accatctcctgcaccggaaccaactcggacgtgggccgctacaactacgtgtcatggtaccagcag<br>caccccgggaaggctcctaagctgatgatctacgaggtgtcctatcggcctagcggtgtcagcaac<br>cggttctccggctccaagtccggcaacactgcttcccttaccatttccgggttgcaagccgaggac<br>gaggccgattactactgttcctcctataccacttcatccaccctggactttggaaccggcaccaag<br>gtcaccgtgctgaccactaccccagcaccgaggcacccacccccggctcctaccatcgcctcccag<br>cctctgtccctcgctccggaggcatgtagacccgcagctggtggggccgtgcatacccggggtctt<br>gacttcgcctgcgatatctacatttgggcccctctggctggtacttgcggggtcctgctgctttca<br>ctcgtgatcactctttactgtaagcgcggtcggaagaagctgctgtacatctttaagcaacccttc<br>atgaggcctgtgcagactactcaagaggaggacggctgttcatgccggttcccagaggaggaggaa<br>ggcggctgcgaactgcgcgtgaaattcagccgcagcgcagatgctccagcctacaagcaggggcag<br>aaccagctctacaacgaactcaatcttggtcggagagaggagtacgacgtgctggacaagcggaga<br>ggacgggacccagaaatgggcgggaagccgcgcagaaagaatccccaagagggcctgtacaacgag<br>ctccaaaaggataagatggcagaagcctatagcgagattggtatgaaaggggaacgcagaagaggc |

TABLE 6A-continued

Human CD22 CAR Constructs

| Name | SEQ ID | Sequence |
|---|---|---|
| | | aaaggccacgacggactgtaccagggactcagcaccgccaccaaggacacctatgacgctcttcac<br>atgcaggccctgccgcctcgg |
| CAR22-21<br>scFv<br>AA | 322 | qvqlvqsgaevkkpgasvkvsckasgytftsyymhwvrqapgqglewmgiinpsggstsyaqkfqg<br>rvtmtrdtststvymelsslrsedtavyycargsygdygdafdiwgqgttvtvssggggsggggsg<br>sggsqsaltqpasvsgspgqsitisctgtssdvggykyvswyqqhpgkapklmiydvsnrpsgvsn<br>rfsgsksgntasltisglqaedeadyycssytssstlvfgggtkltvl |
| CAR22-21<br>scFv NT | 323 | caagtgcaactcgtccagtccggtgcagaagtcaagaaacccggagcctccgtgaaagtgtcctgc<br>aaggcctcgggctacacctt cacctcctactacatgcactgggtgcgccaggcgccgggccaggga<br>cttgagtggatgggtatcatcaacccgtccggcggaagcacctcgtacgcccaaaagtttcagggg<br>agagtgaccatgaccagggacacttcaaccagcaccgtgtacatggaactgtcaagcttgcgctcc<br>gaggatactgccgtctactactgcgcccggggatcgtacggcgacgcttt cgatatc<br>tggggacagggcacaaccgtgaccgtgtcctccggcggagggggctcggcggaggaggctcaggt<br>tccggcgggagccagtccgcactgactcagccagcgtccgtgagcggtagccctgggcagtctatc<br>acgatttcgtgcactggcacctcctccgacgtgggaggctataagtacgtcagctggtaccaacag<br>catccgggaaaggcgcctaagctgatgatctatgacgtcagcaaccggcctccgggggtgtcaaac<br>cggttcagcggttccaagtcgggaaataccgcctccctgaccattagcgggctgcaggccgaagat<br>gaggctgactactactgttcctcctacacttcatcgtccactctcgtgttcggggaggaactaag<br>ctcaccgtgctg |
| CAR22-21<br>soluble<br>scFV NT | 324 | atggccctccctgtcaccgccctgctgcttccgctggctcttctgctccacgccgctcggccccaa<br>gtgcaactcgtccagtccggtgcagaagtcaagaaacccggagcctccgtgaaagtgtcctgcaag<br>gcctcgggctacaccttcacctcctactacatgcactgggtgcgccaggcgccgggccagggactt<br>gagtggatgggtatcatcaacccgtccggcggaagcacctcgtacgcccaaaagtttcaggggaga<br>gtgaccatgaccagggacacttcaaccagcaccgtgtacatggaactgtcaagcttgcgctccgag<br>gatactgccgtctactactgcgcccggggatcgtacggagactacggcgacgctttcgatatctgg<br>ggacagggcacaaccgtgaccgtgtcctccggcggagggggctcggcggaggaggctcaggttcc<br>ggcgggagccagtccgcactgactcagccagcgtccgtgagcggtagccctgggcagtctatcacg<br>atttcgtgcactggcacctcctccgacgtgggaggctataagtacgtcagctggtaccaacagcat<br>ccgggaaaggcgcctaagctgatgatctatgacgtcagcaaccggccctccggggtgtcaaaccgg<br>ttcagcggttccaagtcgggaaataccgcctccctgaccattagcgggctgcaggccgaagatgag<br>gctgactactactgttcctcctacacttcatcgtccactctcgtgttcggggaggaactaagctc<br>accgtgctgggatcgcaccaccatcaccatcatcac |
| CAR22-21<br>soluble<br>scFV AA | 325 | malpvtalllplalllhaarpqvqlvqsgaevkkpgasvkvsckasgytftsyymhwvrqapgqgl<br>ewmgiinpsggstsyaqkfqgrvtmtrdtststvymelsslrsedtavyycargsygdygdafdiw<br>gqgttvtvssggggsggggsggggsqsaltqpasvsgspgqsitisctgtssdvggykyvswyqqh<br>pgkapklmiydvsnrpsgvsnrfsgsksgntasltisglqaedeadyycssytssstlvfgggtkl<br>tvlgshhhhhhhh |
| CAR22-21<br>Full AA | 326 | malpvtalllplalllhaarpqvqlvqsgaevkkpgasvkvsckasgytftsyymhwvrqapgqgl<br>ewmgiinpsggstsyaqkfqgrvtmtrdtststvymelsslrsedtavyycargsygdygdafdiw<br>gqgttvtvssggggsggggsggggsqsaltqpasvsgspgqsitisctgtssdvggykyvswyqqh<br>pgkapklmiydvsnrpsgvsnrfsgsksgntasltisglqaedeadyycssytssstlvfgggtkl<br>tvltttpaprpptpaptiasqplslrpeacrpaaggavhtrgldfacdiyiwaplagtcgvlllsl<br>vitlyckrgrkkllyifkqpfmrpvqttqeedgcscrfpeeeeggcelrvkfsrsadapaykqgqn<br>qlynelnlgrreeydvldkrrgrdpemggkprrknpqeglynelqkdkmaeayseigmkgerrrgk<br>ghdglyqglstatkdtydalhmqalppr |
| CAR22-21<br>Full NT | 327 | atggccctccctgtcaccgccctgctgcttccgctggctcttctgctccacgccgctcggccccaa<br>gtgcaactcgtccagtccggtgcagaagtcaagaaacccggagcctccgtgaaagtgtcctgcaag<br>gcctcgggctacaccttcacctcctactacatgcactgggtgcgccaggcgccgggccagggactt<br>gagtggatgggtatcatcaacccgtccggcggaagcacctcgtacgcccaaaagtttcaggggaga<br>gtgaccatgaccagggacacttcaaccagcaccgtgtacatggaactgtcaagcttgcgctccgag<br>gatactgccgtctactactgcgcccggggatcgtacggagactacggcgacgctttcgatatctgg<br>ggacagggcacaaccgtgaccgtgtcctccggcggagggggctcggcggaggaggctcaggttcc<br>ggcgggagccagtccgcactgactcagccagcgtccgtgagcggtagccctgggcagtctatcacg<br>atttcgtgcactggcacctcctccgacgtgggaggctataagtacgtcagctggtaccaacagcat<br>ccgggaaaggcgcctaagctgatgatctatgacgtcagcaaccggccctccggggtgtcaaaccgg<br>ttcagcggttccaagtcgggaaataccgcctccctgaccattagcgggctgcaggccgaagatgag<br>gctgactactactgttcctcctacacttcatcgtccactctcgtgttcggggaggaactaagctc<br>accgtgctgaccactacccagcaccgaggcctcaccaccatcgcctcccagcct<br>ctgtccctgcgtccggaggcatgtagacccgcagctggtggggccgtgcatacccgggtcttgac<br>ttcgcctgcgatatctacatttgggcccctctggctggtacttgcggggtcctgctgctttcactc<br>gtgatcactctttactgtaagcgcggtcggaagaagctgctgtacatctttaagcaacccttcatg<br>aggcctgtgcagactactcaagaggaggacggctgttcatgccggtccccagaggaggaggaagc<br>ggctgcgaactgcgcgtgaaattcagccgcagcgcagatgctccagcctacaagcaggggcagaac<br>cagctctacaacgaactcaatcttggtcggagagaggagtacgacgtgctggacaagcggagagga<br>cgggacccagaaatgggcgggaagccgcgcagaaagaatcccaagagggcctgtacaacgagctc<br>caaaaggataagtggcagaagcctatagcgagattggtatgaaaggggaacgcagaagaggcaaa<br>ggccacgacggactgtaccagggactcagcaccgccaccaaggacacctatgacgctcttcacatg<br>caggccctgccgcctcgg |
| CAR22-22<br>scFv | 328 | evqlvesgaevkkpgssvkvsckasggtfssyaiswvrqapgqglewmggiipifgtanyaqkfqg<br>rvtitadeststaymelsslrsedtavyycardhkvvrfgywgqgtlvtvssggggsggggsgggg |

TABLE 6A-continued

Human CD22 CAR Constructs

| Name | SEQ ID | Sequence |
|---|---|---|
| AA | | shviltqppsasaslgasvkltctlssghssyaiawhqqqpekgprylmkvnsdgslskgdgipdr<br>fsgstsgaeryltisslqsedeadyycqtwgsgmaifgggtkltvl |
| CAR22-22<br>scFv NT | 329 | gaagtgcaattggtggaatcaggcgcagaagtcaagaaacccggaagcagcgtgaaagtgtcctgc<br>aaggccctcaggaggcaccttctcgtcctatgccatttcctgggtccgccaggcccgggacagggc<br>ctggaatggatgggcggaattatccctatcttcggaaccgcgaactacgcccagaagtttcaggga<br>cgcgtgaccatcactgccgatgaatcaacctccactgcgtacatggaactgtcctccctgcggagc<br>gaggacaccgccgtgtactactgcgcaagggatcataaggtcgtgcggttcggatactggggacag<br>ggaacccttgtgaccgtgtcctccggcggcggggggtccggcggaggggggttccggggaggcgga<br>tcgcacgtgatcctgactcaaccaccctcagcctccgcctctctgggagccagcgtgaagctcacc<br>tgtactctgagctcgggacactcgtcgtacgccatcgcttggcaccagcagcagccggagaaggggg<br>cctagatacctgatgaaggtcaactccgacggttcgctgagcaagggcgacggcatcccggatcgg<br>ttcagcggttccacgtccggcgcggagagatacctcacaatctcctcgctccaatccgaggacgag<br>gctgactactactgccagacctggggtagcggcatggcgattttcggggggtggaactaagctgacc<br>gtgctg |
| CAR22-22<br>soluble<br>scFV NT | 330 | atggccctccctgtcaccgccctgctgcttccgctggctcttctgctccacgccgctcggcccgaa<br>gtgcaattggtggaatcaggcgcagaagtcaagaaacccggaagcagcgtgaaagtgtcctgcaag<br>gccctcaggaggcaccttctcgtcctatgccatttcctgggtccgccaggcccgggacagggcctg<br>gaatggatgggcggaattatccctatcttcggaaccgcgaactacgcccagaagtttcagggacgc<br>gtgaccatcactgccgatgaatcaacctccactgcgtacatggaactgtcctccctgcggagcgag<br>gacaccgccgtgtactactgcgcaagggatcataaggtcgtgcggttcggatactggggacaggga<br>acccttgtgaccgtgtcctccggcggcggggggtccggcggaggggggttccggggaggcggatcg<br>cacgtgatcctgactcaaccaccctcagcctccgcctctctgggagccagcgtgaagctcacctgt<br>actctgagctcgggacactcgtcgtacgccatcgcttggcaccagcagcagccggagaagggggcct<br>agatacctgatgaaggtcaactccgacggttcgctgagcaagggcgacggcatcccggatcggttc<br>agcggttccacgtccggcgcggagagatacctcacaatctcctcgctccaatccgaggacgaggct<br>gactactactgccagacctggggtagcggcatggcgattttcggggggtggaactaagctgaccgtg<br>ctgggatcgcaccaccatcaccatcatcac |
| CAR22-22<br>soluble<br>scFV AA | 331 | malpvtalllplalllhaarpevqlvesgaevkkpgssvkvsckasggtfssyaiswvrqapgqgl<br>ewmggiipifgtanyaqkfqgrvtitadeststaymelsslrsedtavyycardhkvvrfgywgqq<br>tlvtvssgggsgggggsgggshviltqppsasaslgasvkltctlssghssyaiawhqqqpekgp<br>rylmkvnsdgslskgdgipdrfsgstsgaeryltisslqsedeadyycqtwgsgmaifgggtkltv<br>lgshhhhhhhh |
| CAR22-22<br>Full AA | 332 | malpvtalllplalllhaarpevqlvesgaevkkpgssvkvsckasggtfssyaiswvrqapgqgl<br>ewmggiipifgtanyaqkfqgrvtitadeststaymelsslrsedtavyycardhkvvrfgywgqq<br>tlvtvssgggsgggggsgggshviltqppsasaslgasvkltctlssghssyaiawhqqqpekgp<br>rylmkvnsdgslskgdgipdrfsgstsgaeryltisslqsedeadyycqtwgsgmaifgggtkltv<br>ltttpaprppptpaptiasqplslrpeacrpaaggavhtrgldfacdiyiwaplagtcgvlllslvi<br>tlyckrgrkkllyifkqpfmrpvqttqeedgcscrfpeeeeggcelrvkfsrsadapaykqgqnql<br>ynelnlgrreeydvldkrrgrdpemggkprrknpqeglynelqkdkmaeayseigmkgerrrgkgh<br>dglyqglstatkdtydalhmqalppr |
| CAR22-22<br>Full NT | 333 | atggccctccctgtcaccgccctgctgcttccgctggctcttctgctccacgccgctcggcccgaa<br>gtgcaattggtggaatcaggcgcagaagtcaagaaacccggaagcagcgtgaaagtgtcctgcaag<br>gccctcaggaggcaccttctcgtcctatgccatttcctgggtccgccaggcccgggacagggcctg<br>gaatggatgggcggaattatccctatcttcggaaccgcgaactacgcccagaagtttcagggacgc<br>gtgaccatcactgccgatgaatcaacctccactgcgtacatggaactgtcctccctgcggagcgag<br>gacaccgccgtgtactactgcgcaagggatcataaggtcgtgcggttcggatactggggacaggga<br>acccttgtgaccgtgtcctccggcggcggggggtccggcggaggggggttccggggaggcggatcg<br>cacgtgatcctgactcaaccaccctcagcctccgcctctctgggagccagcgtgaagctcacctgt<br>actctgagctcgggacactcgtcgtacgccatcgcttggcaccagcagcagccggagaagggggcct<br>agatacctgatgaaggtcaactccgacggttcgctgagcaagggcgacggcatcccggatcggttc<br>agcggttccacgtccggcgcggagagatacctcacaatctcctcgctccaatccgaggacgaggct<br>gactactactgccagacctggggtagcggcatggcgattttcggggggtggaactaagctgaccgtg<br>ctgaccactaccccagcaccgaggccacccaccccggctcctaccatcgcctcccagcctctgtcc<br>ctgcgtccggaggcatgtagacccgcagctggtgggccgtgcataccccggggtcttgacttcgcc<br>tgcgatatctacatttgggcccctctggctggtacttgcggggtcctgctgctttcactcgtgatc<br>actctttactgtaagcgcggtcggaagaagctgctgtacatctttaagcaaccctcatgaggcct<br>gtgcagactactcaagaggaggacggctgttcatgccggttcccagaggaggaggaaggcggctgc<br>gaactgcgcgtgaaattcagccgcagcgcagatgctccagcctacaaagcaggggcagaaccagctc<br>tacaacgaactcaatcttggtcggagagaggagtacgacgtgctggacaagcggagaggacgggac<br>ccagaaatgggcgggaagccgcgcagaaagaatcccaagagggcctgtacaacgagctccaaaag<br>gataagatggcagaagcctatagcgagattggtatgaaagggaacgcagaagaggcaaaggccac<br>gacggactgtaccagggactcagcaccgccaccaaggacacctatgacgctcttcacatgcaggcc<br>ctgccgcctcgg |
| CAR22-23<br>scFv<br>AA | 334 | qvqlvqsgaevkkpgasvkvsckasgytftsyymhwvrqapgqglewmgiinpsggstsyaqkfqg<br>rvtmtrdtststvymelsslrsedtavyycargdyymdvwgkgttvtvssgggsgggggsgggssq<br>saltqpasasgspgqsvtisctgtssdvggynyvswyqqhpgkapklmiyevskrpsgvpdrfsgs<br>ksgntasltisglqaedeadyycssytssgtlvfgggtkltvl |
| CAR22-23<br>scFv NT | 335 | caagtgcaactcgtccagtccggtgcagaagtcaagaaacccggtgcttccgtgaaagtgtcctgc<br>aaggccctcaggttacaccttcacctcctactacatgcattgggtccgccaagcccccggacaaggc |

… 319 320 …

TABLE 6A-continued

Human CD22 CAR Constructs

| Name | SEQ ID | Sequence |
|---|---|---|
| | | ctggagtggatgggaattatcaacccgtccggcggcagcacaagctacgcccagaagttccaggga cgcgtgactatgaccagagatacctccacctccaccgtgtacatggaactgtcctcactccggtcg gaagataccgccgtgtactactgtgcccggggagactactatatggacgtctggggaaagggcacc accgtgactgtgtcgtcggcggcgggggttcggaggaggaggaagcggtggcgggggaagccag tccgcactgactcagcccgcgtcggccagcgggagccctggccagagcgtgaccatttcgtcgcacc ggaacttcctctgacgtcggcggatacaactacgtgtcctggtaccagcagcaccctggaaaggcc ccgaagctgatgatctacgaggtgtccaagaggccatccggcgtgccggaccggttttcgggatca aagtccgggaacacggccagcctgaccatcagcgggcttcaggctgaggacgaagcggattactac tgctcctcctatacttcatccggcaccttggtgttcggcggagggactaagctgactgtgctc |
| CAR22-23 soluble scFV NT | 336 | atggccctccctgtcaccgccctgctgcttccgctggctcttctgctccacgccgctcggcccaa gtgcaactcgtccagtccggtgcagaagtcaagaaacccggtgcttccgtgaaagtgtcctgcaag gcctcaggttacaccttcacctcctactacatgcattgggtccgccaagcccccggacaaggcctg gagtggatgggaattatcaacccgtccggcggcagcacaagctacgcccagaagttccagggacgc gtgactatgaccagagatacctccacctccaccgtgtacatggaactgtcctcactccggtcggaa gataccgccgtgtactactgtgcccggggagactactatatggacgtctggggaaagggcaccacc gtgactgtgtcgtcggggcggcgggggtcggaggaggaggaagcggtggcgggggaagccagtcc gcactgactcagcccgcgtcggccagcgggagccctggccagagcgtgaccatttcgtcaccgga acttcctctgacgtcggcggatacaactacgtgtcctggtaccagcagcaccctggaaaggccccg aagctgatgatctacgaggtgtccaagaggccatccggcgtgccggaccggttttcgggatcaaag tccgggaacacggccagcctgaccatcagcgggcttcaggctgaggacgaagcggattactactgc tcctcctatacttcatccggcaccttggtgttcggcggagggactaagctgactgtgctcggatcg caccaccatcaccatcatcatcac |
| CAR22-23 soluble scFV AA | 337 | malpvtalllplalllhaarpqvqlvqsgaevkkpgasvkvsckasgytftsyymhwvrqapgqgl ewmgiinpsggstsyaqkfqgrvtmtrdtststvymelsslrsedtavyycargdyymdvwgkgtt vtvssgggggsggggsggggsqsaltqpasasgspgqsvtisctgtssdvggynyvswyqqhpgkap klmiyevskrpsgvpdrfsgsksgntasltisglqaedeadyycssytssgtlvfgggtkltvlgs hhhhhhhh |
| CAR22-23 Full AA | 338 | malpvtalllplalllhaarpqvqlvqsgaevkkpgasvkvsckasgytftsyymhwvrqapgqgl ewmgiinpsggstsyaqkfqgrvtmtrdtststvymelsslrsedtavyycargdyymdvwgkgtt vtvssgggggsggggsggggsqsaltqpasasgspgqsvtisctgtssdvggynyvswyqqhpgkap klmiyevskrpsgvpdrfsgsksgntasltisglqaedeadyycssytssgtlvfgggtkltvltlt tpaprppptpaptiasqplslrpeacrpaaggavhtrgldfacdiyiwaplagtcgvlllslvitly ckrgrkkllyifkqpfmrpvqttqeedgcscrfpeeeeggcelrvkfsrsadapaykqgqnqlyne lnlgrreeydvldkrrgrdpemggkprrknpqeglynelqkdkmaeayseigmkgerrrgkghdgl yqglstatkdtydalhmqalppr |
| CAR22-23 Full NT | 339 | atggccctccctgtcaccgccctgctgcttccgctggctcttctgctccacgccgctcggcccaa gtgcaactcgtccagtccggtgcagaagtcaagaaacccggtgcttccgtgaaagtgtcctgcaag gcctcaggttacaccttcacctcctactacatgcattgggtccgccaagcccccggacaaggcctg gagtggatgggaattatcaacccgtccggcggcagcacaagctacgcccagaagttccagggacgc gtgactatgaccagagatacctccacctccaccgtgtacatggaactgtcctcactccggtcggaa gataccgccgtgtactactgtgcccggggagactactatatggacgtctggggaaagggcaccacc gtgactgtgtcgtcggggcggcgggggtcggaggaggaggaagcggtggcgggggaagccagtcc gcactgactcagcccgcgtcggccagcgggagccctggccagagcgtgaccatttcgtcaccgga acttcctctgacgtcggcggatacaactacgtgtcctggtaccagcagcaccctggaaaggccccg aagctgatgatctacgaggtgtccaagaggccatccggcgtgccggaccggttttcgggatcaaag tccgggaacacggccagcctgaccatcagcgggcttcaggctgaggacgaagcggattactactgc tcctcctatacttcatccggcaccttggtgttcggcggagggactaagctgactgtgctccaccact accccagcaccgaggccacccaccccggctcctaccatcgcctcccagcctctgtccctgcgtccg gaggcatgtagacccgcagctggtggggccgtgcatacccggggtcttgacttcgcctgcgatatc tacatttgggcccctctggctggtacttgcggggtcctgctgcttttcactcgtgatcactctttac tgtaagcgcggtcggaagaagctgctgtacatcttttaagcaacccttcatgaggcctgtcagact actcaagaggaggacggctgttcatgccggttcccagaggaggaaggcggctgcgaactcgc gtgaaattcagccgcagcgcagatgctccagcctacaagcaggggcagaaccagctctacaacgaa ctcaatcttggtcggagagaggagtacgacgtgctggacaagcggagaggacgggacccagaaatg ggcgggaagccgcgcagaaagaatccccaaggggcctgtacaacgagctccaaaaggataagatg gcagaagcctatagcgagattggtatgaaaggggaacgcagaagaggcaaaggccacgacggactg taccagggactcagcaccgccaccaaggacacctatgacgctcttcacatgcaggccctgccgcct cgg |
| CAR22-24 scFv AA | 340 | evqlvesggglvqpggslrlscaasgftfssyamswvrqapgkglewvsyisssssttiyyadsvkg rftisrdnaknslylqmnslraedtavyycardgpiryfdhskafdiwgqgtmvtvssgggggsggg gsggggssseltqdpavsvalgqtvritcqgdslrsyyaswyqqkpgqapvlviygknnrpsgipd rfsgsssgntasltitgaqaedeadyyrnsrdssgnpyvfgtgtkvtvl |
| CAR22-24 scFv NT | 341 | gaagtgcaattggtggaatcaggaggaggacttgtgcaacctggaggatctctgagactgtcatgc gccgcgtcgggattcactttctcctcctacgcaatgtcgtgggtcagacaggcccccggaaagggc ctgggaatgggtgtcatacatcagctcctcctcctccacgatctactactgcgcgcgactctgtgaaggga cggttcaccattagccgggacaacaaaaactccctgtatctgcaaatgaacagctcaggggcg gaagataccgccgtgtactactgtgcgcgcgatggtccgattcgctatttcgaccactccaaggcc ttcgatatctggggccaggggaaccatggtcaccgtgtcgtccggtggaggcggcagcggggggc ggaagcggcggcgggggttcatcctcggagctgactcaggaccccgccgtgtccgtggctctgga cagaccgtgcgcatcacatgccaggagatttcctgcggtcgtactacgcctcctggtaccagcag |

TABLE 6A-continued

Human CD22 CAR Constructs

| Name | SEQ ID | Sequence |
|---|---|---|
| | | aaaccgggccaggcccccgtcctcgtgatctacggaaagaacaacaggccttcgggtatcccagac<br>cggttcagcggcagctccagcggaaacaccgcaagcctcactattaccggggcccaggctgaggac<br>gaggccgactactaccggaactcccgcgactcctcgggcaatccgtacgtctttggtactgggacc<br>aaggtcaccgtgctg |
| CAR22-24 soluble scFV NT | 342 | atggccctccctgtcaccgccctgctgcttccgctggctcttctgctccacgccgctcggcccgaa<br>gtgcaattggtggaatcaggaggaggacttgtgcaacctggaggatctctgagactgtcatgcgcc<br>gcgtcgggattcactttctcctcctacgcaatgtcgtgggtcagacaggcccccggaaagggcctg<br>gaatgggtgtcatacatcagctcctcctcctccacgatctactacgccgactctgtgaagggcg<br>ttcaccattagccgggacaacgcaaagaactcctgtatctgcaaatgaacagcctcagggcgaa<br>gataccgccgtgtactactgtgcgcgcgatggtccgattcgctatttcgaccactccaaggccttc<br>gatatctggggccagggaaccatggtcaccgtgtcgtccggtggaggcggcagcggggggcgga<br>agcggcggcggggttcatcctcggagctgactcaggaccccgccgtgtccgtggctctgggacag<br>accgtgcgcatcacatgccagggagattcctgcggtcgtactacgcctcctggtaccagcagaaa<br>ccgggccaggccccgtcctcgtgatctacggaaagaacaacaggccttcgggtatcccagaccgg<br>ttcagcggcagctccagcggaaacaccgcaagcctcactattaccggggcccaggctgaggacgag<br>gccgactactaccggaactcccgcgactcctcgggcaatccgtacgtctttggtactgggaccaag<br>gtcaccgtgctgggatcgcaccaccaccatcatcatcac |
| CAR22-24 soluble scFV AA | 343 | malpvtallllplallllhaarpevqlvesggglvqpggslrlscaasgftfssyamswvrqapgkgl<br>ewvsyissssstiyyadsvkgrftisrdnaknslylqmnslraedtavyycardgpiryfdhskaf<br>diwgqgtmvtvssggggsggggsggggssseltqdpavsvalgqtvritcqgdslrsyyaswyqqk<br>pgqapvlviygknnrpsgipdrfsgsssgntasltitgaqaedeadyyrnsrdssgnpyvfgtgtk<br>vtvlgshhhhhhhh |
| CAR22-24 Full AA | 344 | malpvtallllplallllhaarpevqlvesggglvqpggslrlscaasgftfssyamswvrqapgkgl<br>ewvsyissssstiyyadsvkgrftisrdnaknslylqmnslraedtavyycardgpiryfdhskaf<br>diwgqgtmvtvssggggsggggsggggssseltqdpavsvalgqtvritcqgdslrsyyaswyqqk<br>pgqapvlviygknnrpsgipdrfsgsssgntasltitgaqaedeadyyrnsrdssgnpyvfgtgtk<br>vtvltttpaprpptpaptiasqplslrpeacrpaaggavhtrgldfacdiyiwaplagtcgvllls<br>lvitlyckrgrkkllyifkqpfmrpvqttqeedgcscrfpeeeeggcelrvkfsrsadapaykqgq<br>nqlynelnlgrreeydvldkrrgrdpemggkpprrknpqeglynelqkdkmaeayseigmkgerrrg<br>kghdglyqglstatkdtydalhmqalppr |
| CAR22-24 Full NT | 345 | atggccctccctgtcaccgccctgctgcttccgctggctcttctgctccacgccgctcggcccgaa<br>gtgcaattggtggaatcaggaggaggacttgtgcaacctggaggatctctgagactgtcatgcgcc<br>gcgtcgggattcactttctcctcctacgcaatgtcgtgggtcagacaggcccccggaaagggcctg<br>gaatgggtgtcatacatcagctcctcctcctccacgatctactacgccgactctgtgaagggcgg<br>ttcaccattagccgggacaacgcaaagaactcctgtatctgcaaatgaacagcctcagggcgaa<br>gataccgccgtgtactactgtgcgcgcgatggtccgattcgctatttcgaccactccaaggccttc<br>gatatctggggccagggaaccatggtcaccgtgtcgtccggtggaggcggcagcggggggcgga<br>agcggcggcggggttcatcctcggagctgactcaggaccccgccgtgtccgtggctctgggacag<br>accgtgcgcatcacatgccagggagattcctgcggtcgtactacgcctcctggtaccagcagaaa<br>ccgggccaggccccgtcctcgtgatctacggaaagaacaacaggccttcgggtatcccagaccgg<br>ttcagcggcagctccagcggaaacaccgcaagcctcactattaccggggcccaggctgaggacgag<br>gccgactactaccggaactcccgcgactcctcgggcaatccgtacgtctttggtactgggaccaag<br>gtcaccgtgctgaccactaccccagcaccgaggccacccaccccggctcctaccatcgcctcccag<br>cctctgtccctcgcgtccggaggcatgtagacccgcagctggtggggccgtgcataccgggtctt<br>gacttcgcctgcgatatctacatttgggcccctctggctggtacttgcggggtcctgctgctttca<br>ctcgtgatcactcttttactgtaagcgcggtcggaagaagctgctgatacatcttaagcaaccttc<br>atgaggcctgtgcagactactcaagaggaggacggctgttcatgccggttcccagaggaggaggaa<br>ggcggctgcgaactgcgcgtgaaattcagccgcagcgcagatgctccagcctacaagcaggggcag<br>aaccagctctacaacgaactcaatcttggtcggagagaggagtacgacgtgctggacaagcggaga<br>ggacgggacccagaaatgggcgggaagccgcgcagaaagaatccccaagagggcctgtacaacgag<br>ctccaaaaggataagatgcagaaagcctatagcgagattggtatgaaaggggaacgcagaagaggc<br>aaaggccacgacggactgtaccagggactcagcaccgccaccaaggacacctatgacgctcttcac<br>atgcaggccctgccgcctcgg |
| CAR22-25 scFv AA | 346 | qvqlvqsgaevkkpgasvkvsckasgytftssyymhwvrqapgqglewmgiinpsggstsyaqkfqg<br>rvtmtrdtsistaymelsrlrsddtavyycaremddssgpdywgqgtltvtssggggsggggsggg<br>gsqsaltqpasvsgspgqsitisctgtssdvggynyvswyqqhpgkapklmiyevsnrpsgvsnrf<br>sgsksgntasltisglqaedeadyycssytssstlvfgtgtkltvl |
| CAR22-25 scFv NT | 347 | caagtgcagctcgtccagtccggtgcagaagtcaagaaaccggtgcttccgtgaaagtgtcctgc<br>aaggcatccggctacacgttcacctcctactacatgcattgggtccgccaagcccccggccaaggc<br>ctggagtggatgggatcattaacccaagcggaggaagcactagctacgcgcagaagtttcaggc<br>cgcgtgaccatgaccagggatacttccatctccaccgcttacatgaactgtcgcggctgagaagc<br>gacgacacagccgtgtactactgtgcccgggaaatggacgactcctccgggcctgattactgggga<br>caggggactctggtcaccgtgtcgtccggtggaggcggatcggggggcggaggttccggcggaggg<br>ggctcacagtccgcgctgacccagccggccagcgtgtcaggatcaccgggccagagcatcaccatt<br>tcctgcaccggaacctcatcgacgtcggcggatataactacgtgtcgtggtaccagcagcacccct<br>ggaaaggcccccgaagctcatgatctacgaggtgtccaatagacccagcggagtgtcgaaccggttc<br>agcgggtccaagtcgggaaacaccgccagcttgaccatctctggactgcaagccgaggacgaagcc<br>gattactactgctcctcgtatacttcctcctcaacccttgtgttcggaactggcactaagctgacc<br>gtgctc |

TABLE 6A-continued

Human CD22 CAR Constructs

| Name | SEQ ID | Sequence |
|---|---|---|
| CAR22-25 soluble scFV NT | 348 | atggccctcccctgtcaccgccctgctgcttccgctggctcttctgctccacgccgctcggccccaa<br>gtgcagctcgtccagtccggtgcagaagtcaagaaacccggtgcttccgtgaaagtgtcctgcaag<br>gcatccggctacacgttcacctcctactacatgcattgggtccgccaagcccccggccaaggcctg<br>gagtggatggggatcattaacccaagcggaggaagcactagctacgcgcagaagtttcagggccgc<br>gtgaccatgaccagggatacttccatctccaccgcttacatggaactgtcgcggctgagaagcgac<br>gacacagccgtgtactactgtgcccgggaaatggacgactcctccgggcctgattactggggacag<br>gggactctggtcaccgtgtcgtccggtggaggcggatcggggggcggaggttccggcggagggggc<br>tcacagtccgcgctgacccagccgccagcgtgtcaggatcaccgggccagagcatcaccatttcc<br>tgcaccggaacctcatcggacgtcggcggatataactacgtgtcgtggtaccagcagcaccctgga<br>aaggcccccgaagctcatgatctacgaggtgtccaatagacccagcggagtgtcgaaccggttcagc<br>gggtccaagtcgggaaacaccgccagcttgaccatctctggactgcaagccgaggacgaagccgat<br>tactactgctcctcgtatacttcctcctcaacccttgtgttcggaactggcactaagctgaccgtg<br>ctcggatcgcaccaccatcaccatcatcac |
| CAR22-25 soluble scFV AA | 349 | malpvtalllplalllhaarpqvqlvqsgaevkkpgasvkvsckasgytftsyymhwvrqapgqgl<br>ewmgiinpsggstsyaqkfqgrvtmtrdtsistaymelsrlrsddtavyycaremddssgpdywgq<br>gtlvtvssggggsggggsggggsqsaltqpasvsgspgqsitisctgtssdvggynyvswyqqhpg<br>kapklmiyevsnrpsgvsnrfsgsksgntasltisglqaedeadyycssytsssstlvfgtgtkltv<br>lgshhhhhhhh |
| CAR22-25 Full AA | 350 | malpvtalllplalllhaarpqvqlvqsgaevkkpgasvkvsckasgytftsyymhwvrqapgqgl<br>ewmgiinpsggstsyaqkfqgrvtmtrdtsistaymelsrlrsddtavyycaremddssgpdywgq<br>gtlvtvssggggsggggsggggsqsaltqpasvsgspgqsitisctgtssdvggynyvswyqqhpg<br>kapklmiyevsnrpsgvsnrfsgsksgntasltisglqaedeadyycssytsssstlvfgtgtkltv<br>ltttpaprpptpaptiasqplslrpeacrpaaggavhtrgldfacdiyiwaplagtcgvlllslvi<br>tlyckrgrkkllyifkqpfmrpvqttqeedgcscrfpeeeeggcelrvkfsrsadapaykqgqnql<br>ynelnlgrreeydvldkrrgrdpemggkprrknpqeglynelqkdkmaeayseigmkgerrrgkgh<br>dglyqglstatkdtydalhmqalppr |
| CAR22-25 Full NT | 351 | atggccctcccctgtcaccgccctgctgcttccgctggctcttctgctccacgccgctcggccccaa<br>gtgcagctcgtccagtccggtgcagaagtcaagaaacccggtgcttccgtgaaagtgtcctgcaag<br>gcatccggctacacgttcacctcctactacatgcattgggtccgccaagcccccggccaaggcctg<br>gagtggatggggatcattaacccaagcggaggaagcactagctacgcgcagaagtttcagggccgc<br>gtgaccatgaccagggatacttccatctccaccgcttacatggaactgtcgcggctgagaagcgac<br>gacacagccgtgtactactgtgcccgggaaatggacgactcctccgggcctgattactggggacag<br>gggactctggtcaccgtgtcgtccggtggaggcggatcggggggcggaggttccggcggagggggc<br>tcacagtccgcgctgacccagccgccagcgtgtcaggatcaccgggccagagcatcaccatttcc<br>tgcaccggaacctcatcggacgtcggcggatataactacgtgtcgtggtaccagcagcaccctgga<br>aaggcccccgaagctcatgatctacgaggtgtccaatagacccagcggagtgtcgaaccggttcagc<br>gggtccaagtcgggaaacaccgccagcttgaccatctctggactgcaagccgaggacgaagccgat<br>tactactgctcctcgtatacttcctcctcaacccttgtgttcggaactggcactaagctgaccgtg<br>ctcaccactaccccagcaccgaggccaccacccccggctcctaccatcgcctcccagcctctgtcc<br>ctgcgtccggaggcatgtagacccgcagctggtggggccgtgcataccgggtcttgacttcgcc<br>tgcgatatctacatttgggcccctctggctggtacttgcggggtcctgctgctttcactcgtgatc<br>actctttactgtaagcgcggtcggaagaagctgctgtacatctttaagcaacccttcatgaggcct<br>gtgcagactactcaagaggaggacggctgtttcatgccggttcccagaggaggaggacggctgc<br>gaactgcgcgtgaaattcagccgcagcgcagatgctccagcctacaagcaggggcagaaccagctc<br>tacaacgaactcaatcttggtcggagagaggagtacgacgtgctggacaagcggagaggacgggac<br>ccagaaatgggcgggaagccgcgcagaaagaatcccccaagagggcctgtacaacgagctccaaaag<br>gataagatggcagaagcctatagcgagattggtatgaaaggggaacgcagaagaggcaaaggccac<br>gacggactgtaccagggactcagcaccgccaccaaggacacctatgacgctcttcacatgcaggcc<br>ctgccgcctcgg |
| CAR22-26 scFv AA | 352 | evqlvesgaevkkpgeslkiscckgsgysftgswigwgrqmpgkglewmgiiypgdsdtryspsfqg<br>qvtisadksistaylqwsslkasdtamyycargflrggdccgaldiwgqgtmvtvssggggsgggg<br>sggggsdivmtqsplslpvtpgepasiscrssqsllhsngynyldwylqkpgqspqlliylgsnra<br>sgvpdrfsgsgsgtdftlkisrveaedvgvyycmqalqtppwtfgqgtklleikr |
| CAR22-26 scFv NT | 353 | gaagtgcagttggtggaatcaggagcagaagtcaagaaacccggagaaagcctgaagatctcgtgc<br>aaagggagcggatactcgttcaccggatcatggattggatggggccgccagatgcctggaaagggt<br>ctggaatggatgggaatcatctacccgggggactccgatactcggtactccccgagctttcagggc<br>caggtcaccatctccgccgacaagtccatctccactgcgtatttgcagtggagctcactgaaggcc<br>tcggcaaccgctatgtactactgcgcccgcggttttcctgaggggcggagattgttgcggcgccttt<br>gatatctgggccaggggaccatggtgaccgtgtcctccggtggtggcggctccggcggaggaggg<br>tccggggaggaggctccgacattgtgatgacccagagccccctgtcctgcccgtgactcctggg<br>gagccagcctcgatcagctgccggtcgtcccagtcccttctgcactccaacggctacaactatctc<br>gattggtacctccagaagcctggtcaaagcccgcagctgctgatctacctcggttcaaacagagct<br>tccggggtgccggacagattcagcggatctggatcgggcacagacttcacgctcaagatttcccgc<br>gtggaggccgaggacgtcggcgtgtactactgtatgcaagcgctgcagacccccgcctggactttc<br>ggacaaggaaccaagctggagattaagcgg |
| CAR22-26 soluble scFV NT | 354 | atggccctcccctgtcaccgccctgctgcttccgctggctcttctgctccacgccgctcggcccgaa<br>gtgcagttggtggaatcaggagcagaagtcaagaaacccggagaaagcctgaagatctcgtgcaaa<br>gggagcggatactcgttcaccggatcatggattggatggggccgccagatgcctggaaagggtctg<br>gaatggatgggaatcatctacccgggggactccgatactcggtactccccgagctttcagggccag<br>gtcaccatctccgccgacaagtccatctccactgcgtatttgcagtggagctcactgaaggcctcg |

US 10,253,086 B2

325                                                                                    326

TABLE 6A-continued

Human CD22 CAR Constructs

| Name | SEQ ID | Sequence |
|---|---|---|
| | | gacaccgctatgtactactgcgcccgcggtttcctgaggggcggagattgttgcggcgcccttgat<br>atctggggccaggggaccatggtgaccgtgtcctccggtggtggcggctccggcggaggagggtcc<br>gggggaggaggctccgacattgtgatgacccagagcccctgtccctgcccgtgactcctggggag<br>ccagcctcgatcagctgccggtcgtcccagtcccttctgcactccaacggctacaactatctcgat<br>tggtacctccagaagcctggtcaaagcccgcagctgctgatctacctcggttcaaacagagcttcc<br>ggggtgccggacagattcagcggatctggatcggcacagacttcacgctcaagatttcccgcgtg<br>gaggccgaggacgtcggcgtgtactactgtatgcaagcgctgcagacccccgccctggactttcgga<br>caaggaaccaagctggagattaagcggggatcgcaccaccatcaccatcatcatcac |
| CAR22-26<br>soluble<br>scFV AA | 355 | malpvtalllplalllhaarpevqlvesgaevkkpgeslkisckgsgysftgswigwgrqmpgkgl<br>ewmgiiypgdsdtryspsfqggvtisadksistaylqwsslkasdtamyycargflrggdccgald<br>iwgqgtmvtvssggggsggggsggggsdivmtqsplslpvtgepasiscrssqsllhsngynyld<br>wylqkpgqspqlliylgsnrasgvpdrfsgsgsgtdftlkisrveaedvgvyycmqalqtppwtfg<br>qgtkleikrgshhhhhhhh |
| CAR22-26<br>Full AA | 356 | malpvtalllplalllhaarpevqlvesgaevkkpgeslkisckgsgysftgswigwgrqmpgkgl<br>ewmgiiypgdsdtryspsfqggvtisadksistaylqwsslkasdtamyycargflrggdccgald<br>iwgqgtmvtvssggggsggggsggggsdivmtqsplslpvtgepasiscrssqsllhsngynyld<br>wylqkpgqspqlliylgsnrasgvpdrfsgsgsgtdftlkisrveaedvgvyycmqalqtppwtfg<br>qgtkleikrttttpaprpptpaptiasqplslrpeacrpaaggavhtrgldfacdiyiwaplagtcg<br>vlllslvitlyckrgrkkllyifkqpfmrpvqttqeedgcscrfpeeeeggcelrvkfsrsadapa<br>ykqgqnqlynelnlgrreeydvldkrrgrdpemggkprrknpqeglynelqkdkmaeayseigmkg<br>errrgkghdglyqglstatkdtydalhmqalppr |
| CAR22-26<br>Full NT | 357 | atggccctccctgtcaccgccctgctgcttccgctggctcttctgctccacgccgctcggcccgaa<br>gtgcagttggtggaatcaggagcagaagtcaagaaacccggagaaagcctgaagatctcgtgcaaa<br>gggagcggatactcgttcaccggatcatggattggatggggccgccagatgcctggaaagggtctg<br>gaatggatgggaatcatctacccgggggactccgatactcggtactcccgagctttcagggccag<br>gtcaccatctccgccgacaagtccatctccactgcgtatttgcagtggagctcactgaaggcctcg<br>gacaccgctatgtactactgcgcccgcggtttcctgaggggcggagattgttgcggcgcccttgat<br>atctggggccaggggaccatggtgaccgtgtcctccggtggtggcggctccggcggaggagggtcc<br>gggggaggaggctccgacattgtgatgacccagagcccctgtccctgcccgtgactcctggggag<br>ccagcctcgatcagctgccggtcgtcccagtcccttctgcactccaacggctacaactatctcgat<br>tggtacctccagaagcctggtcaaagcccgcagctgctgatctacctcggttcaaacagagcttcc<br>ggggtgccggacagattcagcggatctggatcggcacagacttcacgctcaagatttcccgcgtg<br>gaggccgaggacgtcggcgtgtactactgtatgcaagcgctgcagacccccgccctggactttcgga<br>caaggaaccaagctggagattaagcggaccactaccccagcaccgaggccacccaccccggctcct<br>accatcgcctcccagcctctgtccctgcgtccggaggcatgtagaccccgcagctggtggggccgtg<br>catacccggggtcttgacttcgcctgcgatatctacatttgggcccctctggctggtacttgcggg<br>gtcctgctgctttcactcgtgatcactctttactgtaagcgcggtcggaagaagctgctgtacatc<br>tttaagcaacccttcatgaggcctgtgcagactactcaagaggaggacggctgttcatgccggttc<br>ccagaggaggaggaaggcggctgcgaactgcgcgtgaaattcagccgcagcgcagatgctccagcc<br>tacaagcaggggcagaaccagctctacaacgaactcaatcttggtcggagagaggagtacgacgtg<br>ctggacaagcggagaggacgggacccagaaatgggcgggaagccgcgcagaaagaatccccaagag<br>ggcctgtacaacgagctccaaaaggataagatggcagaagcctatagcgagattggtatgaaaggg<br>gaacgcagaagaggcaaaggccacgacggactgtaccagggactcagcaccgccaccaaggacacc<br>tatgacgctcttcacatgcaggccctgccgcctcgg |
| CAR22-27<br>scFv<br>AA | 358 | qvqlqesgpglvkpsetlsltcsvsggsinsyywswirqapgkglewiaftshsgnvkynpsltgr<br>vtiavdtsknqfylevtsvtaadtavyfcargldplfaydafeiwglgtmvtvssggggsggggsg<br>gggseivltqsplslpvtgepasiscrssqsllhsngynyldwylqkpgqspqlliylgsnrasg<br>vpdrfsgsgsgtdftlkisrveaedvgvyycmqvlqtppltfgggtkvdikr |
| CAR22-27<br>scFv NT | 359 | caagtgcaacttcaggaatcaggccccggacttgtgaaaccatcagaaactctctccctcacttgc<br>tccgtgagcgggggtccatcaactcctactactggtcgtggattagacaggcccctggaaaggggg<br>ctggagtggatcgcgttcacttcgcactccggcaacgtcaagtacaacccgtccctgaccggaaga<br>gtgaccattgccgtggataccctccaagaaccagttctacctggaagtcacgtcggtgaccgctgct<br>gacaccgccgtgtacttctgcgcacggggggctggacccattgtttgcctacgatgcgttcgaaatc<br>tgggggctcggaaccatggtcactgtgtcctccggcggaggcggcagcggtggaggaggcagcgga<br>ggaggaggttccgagatcgtgctgacccagagcccctgtccctcccgtgacccctggagaaccg<br>gccagcatttcctgccggtcgagccagtccctgttgcattcaaatggctacaactacctggattgg<br>tatctgcagaagcccggccagtcaccgcaactgctcatctacctgggaagcaaccgcgcctcggt<br>gtcccggaccgcttctccggctcggggtctggcactgactttcacactgaagatctccaggtggag<br>gccgaggacgtgggagtgtattactgtatgcaagtgctgcagaccccgcctctgaccttcggcggt<br>ggaactaaggtcgacatcaagcgg |
| CAR22-27<br>soluble<br>scFV NT | 360 | atggccctccctgtcaccgccctgctgcttccgctggctcttctgctccacgccgctcggcccaa<br>gtgcaacttcaggaatcaggccccggacttgtgaaaccatcagaaactctctccctcacttgctcc<br>gtgagcgggggtccatcaactcctactactggtcgtggattagacaggcccctggaaaggggctg<br>gagtggatcgcgttcacttcgcactccggcaacgtcaagtacaacccgtccctgaccggaagagtg<br>accattgccgtggataccctccaagaaccagttctacctggaagtcacgtcggtgaccgctgctgac<br>accgccgtgtacttctgcgcacggggggctggacccattgtttgcctacgatgcgttcgaaatctgg<br>gggctcggaaccatggtcactgtgtcctccggcggaggcggcagcggtggaggaggcagcggagga<br>ggaggttccgagatcgtgctgacccagagcccctgtccctcccgtgacccctggagaaccggcc<br>agcatttcctgccggtcgagccagtccctgttgcattcaaatggctacaactacctggattggtat<br>ctgcagaagcccggccagtcaccgcaactgctcatctacctgggaagcaaccgcgcctcgggtgtc |

TABLE 6A-continued

Human CD22 CAR Constructs

| Name | SEQ ID | Sequence |
|---|---|---|
| | | ccggaccgcttctccggctcggggtctggcactgacttcacactgaagatctccagggtggaggcc<br>gaggacgtggagtgtattactgtatgcaagtgctgcagaccccgcctctgaccttcggcggtgga<br>actaaggtcgacatcaagcggggatcgcaccaccatcaccatcatcatcac |
| CAR22-27<br>soluble<br>scFV AA | 361 | malpvtalllplalllhaarpqvqlqesgpglvkpsetlsltcsvsggsinsyywswirqapgkgl<br>ewiaftshsgnvkynpsltgrvtiavdtsknqfylevtsvtaadtavyfcargldplfaydafeiw<br>glgtmvtvssggggsggggsggggseivltqsplslpvtpgepasiscrssqsllhsngynyldwy<br>lqkpgqspqlliylgsnrasgvpdrfsgsgsgtdftlkisrveaedvgvyycmqvlqtppltfggg<br>tkvdikrgshhhhhhhh |
| CAR22-27<br>Full AA | 362 | malpvtalllplalllhaarpqvqlqesgpglvkpsetlsltcsvsggsinsyywswirqapgkgl<br>ewiaftshsgnvkynpsltgrvtiavdtsknqfylevtsvtaadtavyfcargldplfaydafeiw<br>glgtmvtvssggggsggggsggggseivltqsplslpvtpgepasiscrssqsllhsngynyldwy<br>lqkpgqspqlliylgsnrasgvpdrfsgsgsgtdftlkisrveaedvgvyycmqvlqtppltfggg<br>tkvdikrttttpaprpptpaptiasqplslrpeacrpaaggavhtrgldfacdiyiwaplagtcgvl<br>llslvitlyckrgrkkllyifkqpfmrpvqttqeedgcscrfpeeeeggcelrvkfsrsadapayk<br>qgqnqlynelnlgrreeydvldkrrgrdpemggkprrknpqeglynelqkdkmaeayseigmkger<br>rrgkghdglyqglstatkdtydalhmqalppr |
| CAR22-27<br>Full NT | 363 | atggccctccctgtcaccgccctgctgcttccgctggctcttctgctccacgccgctcggcccaa<br>gtgcaacttcaggaatcaggcccccggacttgtgaaaccatcagaaactctctccctcacttgctcc<br>gtgagcggggggtccatcaactcctactactggtcgtggattagacaggcccctggaaaggggctg<br>gagtggatcgcgttcacttcgcactccggcaacgtcaagtacaaccgtccctgaccggaagagtg<br>accattgccgtggatacctccaagaaccagttctacctggaagtcacgtcggtgaccgctgctgac<br>accgccgtgtacttctgcgcacgggggctggacccgttgtttgcctacgatgcgttcgaaatctgg<br>gggctcggaaccatggtcactgtgtcctccggcggaggcggcagcggtggaggaggcagcggagga<br>ggaggttccgagatcgtgctgacccagagccccgtgtcctccccgtgaccctggagaaccggcc<br>agcatttcctgccggtcgagccagtccctgttgcattcaaatggctacaactacctggattggtat<br>ctgcagaagcccggccagtcaccgcaactgctcatctacctgggaagcaaccgcgcctcgggtgtc<br>ccggaccgcttctccggctcggggtctggcactgacttcacactgaagatctccagggtggaggcc<br>gaggacgtggagtgtattactgtatgcaagtgctgcagaccccgcctctgaccttcggcggtgga<br>actaaggtcgacatcaagcggaccactaccccagcaccgaggccaccacccccggctcctaccatc<br>gcctcccagcctctgtccctgcgtccggaggcatgtagacccgcagctggtggggccgtgcatacc<br>cggggtcttgacttcgcctgcgatatctacatttggggccctctggctggtacttgcggggtcctg<br>ctgcttttcactcgtgatcactcttactgtaagcgcggtcggaagaagctgctgtatacatctttaag<br>caaccctttcatgaggcctgtgcagactactcaagaggaggacggctgttcatgccggttcccagag<br>gaggaggaaggcggctgcgaactgcgcgtgaaattcagccgcagcgcagatgctccagcctacaag<br>cagggggcagaaccagctctacaacgaactcaatcttggtcggagagaggagtacgacgtgctgac<br>aagcggagaggacgggacccagaaatgggcgggaagccgcgcagaaagaatcccaagagggcctg<br>tacaacgagctccaaaaggataagatggcagaagcctatagcgagattggtatgaaaggggaacgc<br>agaagaggcaaaggccacgacggactgtaccagggactcagcaccgccaccaaggacacctatgac<br>gctcttcacatgcaggccctgccgcctcgg |
| CAR22-28<br>scFv AA | 364 | evqlvesgggglvkpggslrlscaasgftfsdyymswirqapgkglewvsyisssgstiyyadsvkg<br>rftisrdnaknslylqmnslraedtavyycarddfwsgsvdywgqgtlvtvssggggsggggsggg<br>gsggggssyvltqppsvsvapgktatitcggtnigsknvhwyqqkpgqapvlaiyydsdrpsgipe<br>rfsgsnsgntatltisrveagdeadyfcqvwdsssdhwvfgggtkltvl |
| CAR22-28<br>scFv NT | 365 | gaagtgcagttggtggaatctggtggtggactcgtgaaacctggaggaagcttgcgcctgtcttgc<br>gcggcctccggcttcactttctcggattactacatgtcctggattagacaggctccggggaaggga<br>ctcgaatgggtgtcctacatttcatcaagcggcagcaccatctactatgcggactccgtgaagggg<br>cggttcactatttcccgggataacgcaaagaacagcctgtaccttcaaatgaattcactgcgcgcc<br>gaggacaccgccgtgtactattgcgcccgggatgacttctggtcggggtccgtggactactgggcc<br>caggggaccctggtcaccgtgtcctcggaggaggaggaagcggggaggcggttccggggcggc<br>ggctcgggcggcggtggctccagctacgtgctcacccagccgcctccgtgtccgtggccccggga<br>aagaccgccaccatcacctgtggaggaacgaacatcggctccaagaacgtccattggtaccagcag<br>aagcccggacaggcccccgtgctggcaatctactacgactccgaccgcccaagcggtatccctgaa<br>aggttctccggctccaacagcggaaacactgcgactctgaccatctcaagagtggaggctggcgat<br>gaggccgactacttctgccaagtctgggactcgtcctcggaccactgggtgtttggggaggcacc<br>aagctgactgtcctg |
| CAR22-28<br>soluble<br>scFV NT | 366 | atggccctccctgtcaccgccctgctgcttccgctggctcttctgctccacgccgctcggcccgaa<br>gtgcagttggtggaatctggtggtggactcgtgaaacctggaggaagcttgcgcctgtcttgcgcg<br>gcctccggcttcactttctcggattactacatgtcctggattagacaggctccggggaagggactc<br>gaatgggtgtcctacatttcatcaagcggcagcaccatctactatgcggactccgtgaaggggcgg<br>ttcactatttcccgggataacgcaaagaacagcctgtaccttcaaatgaattcactgcgcgccgag<br>gacaccgccgtgtactattgcgcccgggatgacttctggtcggggtccgtggactactgggccag<br>gggaccctggtcaccgtgtcctcggaggaggaggaagcggggaggcggttccggggcggcggc<br>tcgggcggcggtggctccagctacgtgctcacccagccgcctccgtgtccgtggccccggga<br>accgccaccatcacctgtggaggaacgaacatcggctccaagaacgtccattggtaccagcagaag<br>cccggacaggcccccgtgctggcaatctactacgactccgaccgcccaagcggtatccctgaaagg<br>ttctccggctccaacagcggaaacactgcgactctgaccatctcaagagtggaggctggcgatgag<br>gccgactacttctgccaagtctgggactcgtcctcggaccactgggtgtttggggaggcaccaag<br>ctgactgtcctgggatcgcaccaccatcaccatcatcatcac |

TABLE 6A-continued

Human CD22 CAR Constructs

| Name | SEQ ID | Sequence |
|---|---|---|
| CAR22-28 soluble scFV NT | 367 | malpvtalllplalllhaarpevqlvesgggvkpggslrlscaasgftfsdyymswirqapgkgl ewvsyisssgstiyyadsvkgrftisrdnaknslylqmnslraedtavyycarddfwsgsvdywgq gtlvtvssggggsggggsggggsggggssyvltqppsvsvapgktatitcggtnigsknvhwyqqk pgqapvlaiyydsdrpsgiperfsgsnsgntatltisrveagdeadyfcqvwdsssdhwvfgggtk ltvlgshhhhhhhh |
| CAR22-28 Full AA | 368 | malpvtalllplalllhaarpevqlvesgggvkpggslrlscaasgftfsdyymswirqapgkgl ewvsyisssgstiyyadsvkgrftisrdnaknslylqmnslraedtavyycarddfwsgsvdywgq gtlvtvssggggsggggsggggsggggssyvltqppsvsvapgktatitcggtnigsknvhwyqqk pgqapvlaiyydsdrpsgiperfsgsnsgntatltisrveagdeadyfcqvwdsssdhwvfgggtk ltvltttpaprpptpaptiasqplslrpeacrpaaggavhtrgldfacdiyiwaplagtcgvllls lvitlyckrgrkkllyifkqpfmrpvqttqeedgcscrfpeeeeggcelrvkfsrsadapaykqgq nqlynelnlgrreeydvldkrrgrdpemggkprrknpqeglynelqkdkmaeayseigmkgerrrg kghdglyqglstatkdtydalhmqalppr |
| CAR22-28 Full NT | 369 | atggccctccctgtcaccgccctgctgcttccgctggctcttctgctccacgccgctcggcccgaa gtgcagttggtggaatctggtggtggactcgtgaaacctggaggaagcttgcgcctgtcttgcgcg gcctccggcttcactttctcggattactacatgtcctggattagacaggctccggggaagggactc gaatgggtgtcctacatttcatcaagcggcagcaccatctactatgcggactccgtgaaggggcgg ttcactatttcccgggataacgcaaagaacagcctgtaccttcaaatgaattcactgcgcgccgag gacaccgccgtgtactattgcgcccgggatgacttctggtcgggtccgtggactactggggccag gggaccctggtcaccgtgtcctcgggaggaggaggaaagcggggaggcggttccggggggcggc tcgggcggcggtggctccagctacgtgctcacccagccgccctccgtgtccgtggccccggggaag accgccaccatcacctgtggaggaacgaacatcggctccaagaacgtccattggtaccagcagaag cccggacaggcccccgtgctgcaatctactacgactccgaccgcccaagcggtatccctgaaagg ttctccggctccaacagcggaaacactgcgactctgaccatctcaagagtggaggctggcgatgag gccgactacttctgccaagtctgggactcgtcctcggaccactgggtgtttgggggaggcaccaag ctgactgtcctgaccactaccccagcaccgaggcacccaccccggctcctaccatcgcctcccag cctctgtccctgcgtccggaggcatgtagacccgcagttgcataccccgggtctt gacttcgcctgcgatatctacatttgggcccctctggctggtacttgcgggtcctgctgctttca ctcgtgatcactctttactgtaagcgcggtcggaagaagctgctgtacatctttaagcaaccctc atgaggcctgtcagactactcaagaggaggacggctgttcatgccggttcccagaggaggaggaa ggcggctgcgaactgcgcgtgaaattcagccgcagcgcagatgctccagcctacaagcaggggcag aaccagctctcaacgaactcaatcttggtcggagagaggagtacgacgtgctggacaagcggaga ggacgggacccagaaatgggcgggaagccgcgcagaaagaatccccaagagggcctgtacaacgag ctccaaaaggataagatggcagaagcctatagcgagattggtatgaaaggggaacgcagaagaggc aaaggccacgacgactgtaccagggactcagcaccgccaccaaggacacctatgacgctcttcac atgcaggccctgccgcctcgg |
| CAR22-29 scFv AA | 370 | qvqlvqsgaevkkpgasvkvsckasgytftsyymhwvrqapgqglewmgiinpsggstsyaqkfqg rvtmtrdtststvymelsslrsedtavyycareddssgytspfdywgqgtlvtvssggggsggggs ggggsggggsrsseyeltqppsvsvapgetasiacgghnirsknvhwyqqkpgqapvlvisydgdrpsg iperfsgsnlgstatltisrveagdeadyycqvwdsdshyvfgtgtkvtvl |
| CAR22-29 scFv NT | 371 | caagtccaactcgtccagtccggtgcagaagtcaagaaacccggagcttccgtgaaagtgtcctgc aaggcctcggggtacacattcacctcctactacatgcactgggtgcgccaggcccccgggccaggga ctggaatggatgggaatcattaacccgtccggcggatcgaccagctacgcccagaagtttcaggga cgcgtgaccatgacccgggacactagcaccagcactgtgtacatggaactgagctcactgcggtcc gaggacactgcggtgtactattgcgcccgggaggacgattcctccgggtacacttcgcccttcgac tattggggacagggaaccttggtcaccgtgtcatcggggtggtggaggaagcggaggaggcggctcc ggcggcgggggtcaggcggtggcagaagctcctacgaactgacccagcctccgtccgtgtccgtg gcccccggcgaaaccgcctcgatcgcgtgggagggcacaatattcggagcaagaacgtgcattgg taccagcagaagccgggacaggcaccagtgctcgtgatctcctacgatggggacaggccttctggc atccctgagagattcagcgggtccaacctgggctccactgctaccctgaccatctcgcgcgtggaa gccggggatgaggccgactactactgccaagtctgggactccgacagcgatcactacgtgttcgga actggaaccaaggtcacggtgctt |
| CAR22-29 Soluble scFv-nt | 372 | atggccctccctgtcaccgccctgctgcttccgctggctcttctgctccacgccgctcggcccaa gtccaactcgtccagtccggtgcagaagtcaagaaacccggagcttccgtgaaagtgtcctgcaag gcctcggggtacacattcacctcctactacatgcactgggtgcgccaggcccccgggccagggactg gaatggatgggaatcattaacccgtccggcggatcgaccagctacgcccagaagtttcagggacgc gtgaccatgacccgggacactagcaccagcactgtgtacatggaactgagctcactgcggtccgag gacactgcggtgtactattgcgcccgggaggacgattcctccgggtacacttcgcccttcgactat tggggacagggaaccttggtcaccgtgtcatcggggtggtggaggaagcggaggaggcggctccggc ggcgggggtcaggcggtggcagaagctcctacgaactgacccagcctccgtccgtgtccgtggcc cccggcgaaaccgcctcgatcgcgtgtggagggcacaatattcggagcaagaacgtgcattggtac cagcagaagccgggacaggcaccagtgctcgtgatctcctacgatggggacaggccttctggcatc cctgagagattcagcgggtccaacctgggctccactgctaccctgaccatctcgcgcgtggaagcc ggggatgaggccgactactactgccaagtctgggactccgacagcgatcactacgtgttcggaact ggaaccaaggtcacggtgcttggatcgcaccaccatcaccatcac |
| CAR22-29 soluble scFv AA | 373 | malpvtalllplalllhaarpqvqlvqsgaevkkpgasvkvsckasgytftsyymhwvrqapgqgl ewmgiinpsggstsyaqkfqgrvtmtrdtststvymelsslrsedtavyycareddssgytspfdy wgqgtlvtvssggggsggggsggggsggggsrsseyeltqppsvsvapgetasiacgghnirsknvhwy |

TABLE 6A-continued

Human CD22 CAR Constructs

| Name | SEQ ID | Sequence |
|---|---|---|
| | | qqkpgqapvlvisydgdrpsgiperfsgsnlgstatltisrveagdeadyycqvwdsdsdhyvfgt<br>gtkvtvlgshhhhhhhh |
| CAR22-29<br>Full AA | 374 | malpvtalllplalllhaarpqvqlvqsgaevkkpgasvkvsckasgytftssyymhwvrqapgqgl<br>ewmgiinpsggstsyaqkfqgrvtmtrdtststvymelsslrsedtavyycareddssgytspfdy<br>wgqgtlvtvssggggsggggsggggsgggrssyeltqppsvsvapgetasiacgghnirsknvhwy<br>qqkpgqapvlvisydgdrpsgiperfsgsnlgstatltisrveagdeadyycqvwdsdsdhyvfgt<br>gtkvtvltttpaprpptpaptiasqplslrpeacrpaaggavhtrgldfacdiyiwaplagtcgvl<br>llslvitlyckrgrkkllyifkqpfmrpvqttqeedgcscrfpeeeeggcelrvkfsrsadapayk<br>qgqnqlynelnlgrreeydvldkrrgrdpemggkprrknpqeglynelqkdkmaeayseigmkger<br>rrgkghdglyqglstatkdtydalhmqalppr |
| CAR22-29<br>Full NT | 375 | atggccctccctgtcaccgccctgctgctgcttccgctggctcttctgctccacgccgctcggcccaa<br>gtccaactcgtccagtccggtgcagaagtcaagaaacccggagcttccgtgaaagtgtcctgcaag<br>gcctcggggtacacattcacctcctactacatgcactgggtgcgccaggcccgggccagggactg<br>gaatggatgggaatcattaacccgtccggcggatcgaccagctacgcccagaagtttcagggacgc<br>gtgaccatgacccgggacactagcaccagcactgtgtacatggaactgagctcactgcggtccgag<br>gacactgcggtgtactattgcgcccgggaggacgattcctccgggtacacttcgcccttcgactat<br>tggggacagggaaccttggtcaccgtgtcatcggctggtggaggaagcggaggaggcggctccggc<br>ggcggggggttcaggcggtggcagaagctcctacgaactgacccagcctcgtccgtgtccgtggcc<br>cccggcgaaaccgcctcgatcgcgtgtgggggcacaatattcggagcaagaacgtgcattggtac<br>cagcagaagccgggacaggcaccagtgctcgtgatctcctacgatggggacaggcctttctggtca<br>cctgagagattcagcgggtccaacctgggctccactgctaccctgaccatctcgcgcgtggaagcc<br>ggggatgaggccgactactactgccaagtctgggactccgacagcgatcactacgtgttcggaact<br>ggaaccaaggtcacggtgcttaccactacccagcaccgaggccaccaccccggctcctaccatc<br>gcctcccagcctctgtccctgcgtccggaggcatgtagaccccgcagctggtggggccgtgcatacc<br>cggggtcttgacttcgcctgcgatatctacatttgggcccctctggctggtacttgcggggtcctg<br>ctgctttcactcgtgatcactctttactgtaagcgcggtcggaagaagctgctgtacatctttaag<br>caaccccttcatgaggcctgtgcagactactcaagaggaggacggctgttcatgccggttcccagag<br>gaggaggaaggcggctgcgaactgcgcgtgaaattcagccgcagcgcagatgctccagcctacaag<br>caggggcagaaccagctctacaacgaactcaatcttggtcggagagaggagtacgacgtgctggac<br>aagcggagaggacgggacccagaaatgggcgggaagccgcgcagaaagaatcccaagagggcctg<br>tacaacgagctccaaaaggataagatggcagaagcctatagcgagattggtatgaaaggggaacgc<br>agaagaggcaaaggccacgacggactgtaccagggactcagcaccgccaccaaggacacctatgac<br>gctcttcacatgcaggccctgccgcctcgg |
| CAR22-30<br>scFv AA | 376 | evqlvesgaevkkpgasvkvsckasgytftgyymhwvrqapgqglewmgwinpnsggtnyaqkfqg<br>rvtmtrdtsistaymelsrlrsddtavyycarepassswygyyyymdvwgkgtlvtvssggggs<br>ggsggggsggggsdiqmtqspsslsasvgdrvtitcrasqsintylnwyqqkpgkppkllyyaasn<br>lqsgvpsrfsgsgsgthftltisslqpddfatyycqqsysslltfgggtkleik |
| CAR22-30<br>scFv NT | 377 | gaagtgcagttggtggaatcaggagcagaagtcaagaaacccggagcatcagtcaaagtgtcctgc<br>aaggcctccgggtacactttcactggttactacatgcattgggtgcgccaggcgcccggacaagga<br>ctcgagtggatgggctggattaaccccaactccggcggaaccaactacgcccagaagttccagggt<br>agagtgacgatgactcgggacaccagcatctccaccgcgtacatggagctgtcgagactgaggtcc<br>gacgataccgccgtgtactactgcgcccgggaacggcttcctcgtcttggtacggatattactat<br>tacatggatgtctggggaaagggaacacttgtcactgtgtccagcggtggcggaggcagcggcggt<br>ggagggtccggcggcggcggatcgggaggggggaggcagcggacatccagatgactcagtccccatcc<br>tcgctgtcggctagcgtgggcgaccgcgtgaccattacctgtcgggccagccaatccatcaacacc<br>tacctgaactggtaccagcagaagccggggaagcctccaaagctgctcatctacgcggcctcaaat<br>ctgcaatccggggtgccttcccggttctccggttccggttcggggacccacttcactctgaccatt<br>agctcactgcaaccggacgactttgccacctactactgccagcagagctactcctccctcctgacc<br>ttcggcggaggaaccaagctcgagatcaag |
| CAR22-30<br>soluble scFv<br>NT | 378 | atggccctccctgtcaccgccctgctgctgctgcttccgctggctcttctgctccacgccgctcggcccgaa<br>gtgcagttggtggaatcaggagcagaagtcaagaaacccggagcatcagtcaaagtgtcctgcaag<br>gcctccgggtacactttcactggttactacatgcattgggtgcgccaggcgcccggacaaggactc<br>gagtggatgggctgattaaccccaactccggcggaaccaactacgcccagaagttccagggtaga<br>gtgacgatgactcgggacaccagcatctccaccgcgtacatggagctgtcgagactgaggtccgac<br>gataccgccgtgtactactgcgcccgggaacggcttcctcgtcttggtacggatattactattac<br>atggatgtctggggaaagggaacacttgtcactgtgtccagcggtggcggaggcagcggcggtgga<br>gggtccggcggcggcggatcgggaggggggaggcagcggacatccagatgactcagtccccatcctcg<br>ctgtcggctagcgtgggcgaccgcgtgaccattacctgtcgggccagccaatccatcaacacctac<br>ctgaactggtaccagcagaagccggggaagcctccaaagctgctcatctacgcggcctcaaatctg<br>caatccggggtgccttcccggttctccggttccggttcggggacccacttcactctgaccattagc<br>tcactgcaaccggacgactttgccacctactactgccagcagagctactcctccctcctgaccttc<br>ggcggaggaaccaagctcgagatcaagggatcgcaccaccatcaccatcatcac |
| CAR22-30<br>soluble scFv<br>AA | 379 | malpvtalllplalllhaarpevqlvesgaevkkpgasvkvsckasgytftgyymhwvrqapgqgl<br>ewmgwinpnsggtnyaqkfqgrvtmtrdtsistaymelsrlrsddtavyycarepassswygyyyy<br>mdvwgkgtlvtvssggggsggggsggggsggggsdiqmtqspsslsasvgdrvtitcrasqsinty<br>lnwyqqkpgkppkllyyaasnlqsgvpsrfsgsgsgthftltisslqpddfatyycqqsysslltf<br>gggtkleikgshhhhhhhh |
| CAR22-30<br>Full AA | 380 | malpvtalllplalllhaarpevqlvesgaevkkpgasvkvsckasgytftgyymhwvrqapgqgl<br>ewmgwinpnsggtnyaqkfqgrvtmtrdtsistaymelsrlrsddtavyycarepassswygyyyy |

TABLE 6A-continued

Human CD22 CAR Constructs

| Name | SEQ ID | Sequence |
|---|---|---|
| | | mdvwgkgtlvtvssggggsggggsggggsggggsdiqmtqspsslsasvgdrvtitcrasqsinty
lnwyqqkpgkppklliyaasnlqsgvpsrfsgsgsgthftltisslqpddfatyycqqsysslltf
gggtkleiktttpaprpptpaptiasqplslrpeacrpaaggavhtrgldfacdiyiwaplagtcg
vlllslvitlyckrgrkkllyifkqpfmrpvqttqeedgcscrfpeeeeggcelrvkfsrsadapa
ykqgqnqlynelnlgrreeydvldkrrgrdpemggkprrknpqeglynelqkdkmaeayseigmkg
errrgkghdglyqglstatkdtydalhmqalppr |
| CAR22-30 Full NT | 381 | atggccctccctgtcaccgccctgctgcttccgctggctcttctgctccacgccgctcggcccgaa
gtgcagttggtggaatcaggagcagaagtcaagaaaccggagcatcagtcaaagtgtcctgcaag
gcctccgggtacactttcactggttactacatgcattgggtgcgccaggcgcccggacaaggactc
gagtggatgggctggattaaccccaactcggcgaaccaactacgcccagaagttccagggtaga
gtgacgatgactcgggacaccagcatctccaccgcgtacatggagctgtcgagactgaggtccgac
gataccgccgtgtactactgcgcccgggaaccttcctcgtcttggtacggatattactattac
atggatgtctggggaaagggaacacttgtcactgtgtccagcggtggcggaggcagcggcggtgga
gggtccggcggcggcggatcgggaggggggaggcagcgacatccagatgactcagtccccatcctcg
ctgtcggctagcgtgggcgaccgcgtgaccattacctgtcgggcagccaatccatcaacacctac
ctgaactggtaccagcagaagccggggaagcctccaaagctgctcatctacgcggcctcaaatctg
caatccggggtgccttcccggttctccggttccggttcggggacccacttcactctgaccattagc
tcactgcaaccggacgactttgccacctactactgccagcagagctactcctccctcctgaccttc
ggcggaggaaccaagctcgagatcaagaccactaccccagcaccgaggccacccaccccggctcct
accatcgcctcccagcctctgtccctgcgtccggaggcatgtagacccgcagctggtggggccgtg
catacccggggtcttgacttcgcctgcgatatctacatttgggccctctggctggtacttgcggg
gtcctgctgctttcactcgtgatcactcttttactgtaagcgcggtcggaagaagctgctgtacatc
tttaagcaaccttcatgaggcctgtcagactactcaagaggaggacggctgttcatgccggttc
ccagaggaggaggaaggcggctgcgaactgcgcgtgaaattcagccgcagcgcagatgctccagcc
tacaagcaggggcagaaccagctctacaacgaactcaatcttggtcggagagaggagtacgacgtg
ctggacaagcggagaggacgggacccagaaatgggcgggaagccgcgcagaaagaatccccaagag
ggcctgtacaacgagctccaaaaggataagatggcagaagcctatagcgagattggtatgaaaggg
gaacgcagaagaggcaaaggccacgacggactgtaccagggactcagcaccgccaccaaggacacc
tatgacgctcttcacatgcaggccctgccgcctcgg |
| CAR22-31 scFv AA | 382 | Qvqlvqsgaevkkpgasvkvsckasgytftsydinwvrqatgqglewmgwmnpnsgntgyaqkfqg
rvtmtrntsistaymelsslrsedtavyycargdsnywsyygmdvwgqgtlvtvssggggsggggs
ggggsggggsqsvltqprsvsgspgqsvtisctgtssdvggynyvswyqqhpgeapkliiydadkr
psgisnrfssgksgntasltisglqvedeadyyccsyaggstwvfgggtkvtvl |
| CAR22-31 scFv NT | 383 | Caagtccaactcgtccagtccggtgcagaagtcaagaaaccggagcttccgtgaaagtgtcctgc
aaggcctcggggttacaccttcacctcctacgacattaactgggtgcgccaggcccagggcaggga
ctggaatggatgggctggatgaaccctaactcggcaacaccggctatgcccagaagtttcaggga
cgcgtgacgatgacccggaatacctccatctcaaccgcctacatggaactgagcagcctgaggtcc
gaggatactgcagtgtactactgcgctcggggagactccaactattggtcctactacggaatggac
gtgtggggccagggaaccctcgtcactgtgtcgagcggggaggcggttcaggggcggcggaagc
ggaggcggagggtccggcggaggaggttctcagagcgtgctgactcaaccgagatccgtgtccggg
agcccgggccagtcagtgactatctcgtgcaccgggaccagctccgacgtgggagggtacaactac
gtgtcgtggtaccagcagcaccccggagaggcgcaaagttgattatctacgacgccgataagcgc
cctcgggaatctccaaccggttctcctccgggaagtccggcaacactgcctccctgaccatcagc
ggacttcaagtggaggacgaagcggattactactgctgttcatacgccggcggatcgacctggtg
ttcggcggtggtaccaaggtcacagtgctg |
| CAR22-31 soluble scFv NT | 384 | atggccctccctgtcaccgccctgctgcttccgctggctcttctgctccacgccgctcggcccaa
gtccaactcgtccagtccggtgcagaagtcaagaaaccggagcttccgtgaaagtgtcctgcaag
gcctcggggttacaccttcacctcctacgacattaactgggtgcgccaggccactgggcagggactg
gaatggatgggctggatgaaccctaactcggcaacaccggctatgcccagaagtttcagggacgc
gtgacgatgacccggaataccttccatctcaaccgcctacatggaactgagcagcctgaggtccgag
gatactgcagtgtactactgcgctcggggagactccaactattggtcctactacggaatggacgtg
tggggccagggaaccctcgtcactgtgtcgagcggggaggcggttcaggggcggcggaagcgga
ggcggagggtccggcggaggaggttctcagagcgtgctgactcaaccgagatccgtgtccgggagc
ccgggccagtcagtgactatctcgtgcaccgggaccagctccgacgtgggagggtacaactacgtg
tcggtggtaccagcagcaccccggagaggcgcaaagttgattatctacgacgccgataagcgccct
cgggaatctccaaccggttctcctccgggaagtccggcaacactgcctccctgaccatcagcgga
cttcaagtggaggacgaagcggattactactgctgttcatacgccggcggatcgacctggtgttc
ggcggtggtaccaaggtcacagtgctgggatcgcaccaccatcaccatcatcac |
| CAR22-31 soluble scFv AA | 385 | malpvtalllplalllhaarpqvqlvqsgaevkkpgasvkvsckasgytftsydinwvrqatgqgl
ewmgwmnpnsgntgyaqkfqgrvtmtrntsistaymelsslrsedtavyycargdsnywsyygmdv
wgqgtlvtvssggggsggggsggggsggggsqsvltqprsvsgspgqsvtisctgtssdvggynyv
swyqqhpgeapkliiydadkrpsgisnrfssgksgntasltisglqvedeadyyccsyaggstwvf
gggtkvtvlgshhhhhh |
| CAR22-31 Full AA | 386 | malpvtalllplalllhaarpqvqlvqsgaevkkpgasvkvsckasgytftsydinwvrqatgqgl
ewmgwmnpnsgntgyaqkfqgrvtmtrntsistaymelsslrsedtavyycargdsnywsyygmdv
wgqgtlvtvssggggsggggsggggsggggsqsvltqprsvsgspgqsvtisctgtssdvggynyv
swyqqhpgeapkliiydadkrpsgisnrfssgksgntasltisglqvedeadyyccsyaggstwvf
gggtkvtvltttpaprpptpaptiasqplslrpeacrpaaggavhtrgldfacdiyiwaplagtcg
vlllslvitlyckrgrkkllyifkqpfmrpvqttqeedgcscrfpeeeeggcelrvkfsrsadapa |

TABLE 6A-continued

Human CD22 CAR Constructs

| Name | SEQ ID | Sequence |
|---|---|---|
| | | ykqgqnqlynelnlgrreeydvldkrrgrdpemggkprrknpqeglynelqkdkmaeayseigmkg errrgkghdglyqglstatkdtydalhmqalppr |
| CAR22-31 Full NT | 387 | atggccctcccctgtcaccgccctgctgcttccgctggctcttctgctccacgccgctcggcccaa gtccaactcgtccagtccggtgcagaagtcaagaaaccggagcttccgtgaaagtgtcctgcaag gcctcggggttacaccttcacctcctacgacattaactgggtgcgccaggccactgggcagggactg gaatggatgggctgatgaaccctaactcgggcaacaccggctatgcccagaagtttcagggacgc gtgacgatgaccggaatacctccatctcaaccgcctacatggaactgagcagcctgaggtccgag gatactgcagtgtactactgcgctcggggagactccaactattggtcctactacgaatggacgtg tggggccagggaaccctcgtcactgtgtcgagcggggaggcggttcaggggcggcggaagcgga ggcggagggtccggcggaggaggttctcagagcgtgctgactcaaccgagatccgtgtccgggagc ccgggccagtcagtgactatctcgtgcaccgggaccagctccgacgtggggagggtacaactacgtg tcgtggtaccagcagcaccccggagaggcgccaaagttgattatctacgacgccgataagcgccct tcgggaatctccaaccggttctcctccgggaagtccggcaacactgcctccctgaccatcagcgga cttcaagtcgaggacgaagcggattactactgctgttcatacgccggcgatcgacctgggtgttc ggcggtggtaccaaggtcacagtgctgaccactaccccagcaccgaggccacccaccccggctcct accatcgcctcccagcctctgtccctgcgtccggaggcatgtagacccgcagctggtggggccgtg catacccggggtcttgacttcgcctgcgatatctacatttttgggcccctctggctggtacttgcggg gtcctgctgctttcactcgtgatcactcttttactgtaagcgcggtcggaagaagctgctgtacatc tttaagcaaccctcatgaggcctgtcagactactcaagaggaggacggctgttcatgccggttc ccagaggaggaaggcggctgcgaactgcgcgtgaaattcagccgcagcgcagatgctccagcc tacaagcaggggcagaaccagctctacaacgaactcaatcttggtcggagagaggagtacgacgtg ctggacaagcggagaggacgggacccagaaatgggcgggaagccgcgcagaaagaatccccaagag ggcctgtacaacgagctccaaaaggataagatggcagaagcctatagcgagattggtatgaaaggg gaacgcagaagaggcaaaggccacgacggactgtaccagggactcagcaccgccaccaaggacacc tatgacgctcttcacatgcaggccctgccgcctcgg |
| CAR22-32 scFv AA | 388 | qvqlvqsgaevkkpgasvkvsckasgytftsygiswvrqapgqglewmgwisayngntnyaqklqg rvtmttdtststaymelrslrsddtavyycasfsssdsydywgqgtlvtvssggggsggggsgggg sggggseivltqspatlsvspgeratlscrasqsvtsnlawyqqkpgqaprlliyaastratgipa rfsgsgsgteftltissmqsedfavyfcqqyhtwppltfgggtkveikt |
| CAR22-32 scFv NT | 389 | caagtccaactcgtccagtccggtgcagaagtcaagaaaccaggagcttcagtgaaagtgtcgtgc aaggcctccgggtataccttcacttcctacggcattagctgggtgcggcaggcccccggccaaggg ctggagtggatgggctggatcagcgcctacaacggaaacaccaactacgcccagaagctgcaggga cgcgtgaccatgaccactgacacctccacttcgaccgcgtacatggagctcagatcactgcgctcc gacgataccgccgtgtactactgcgcctccttctcctcctccgactcctacgactactggggacag gggactctggtcactgtgtcgtccggcggcggcggtggcggaggcagcggtggaggcggttcg tcggaggaggagggtccgaaatcgtgctgacccagtccccgctaccctttccgtgagcccggggaa cgggccaccctgtcttgccgcgcgtcacaaagcgtgacttcgaacctggcctggtaccagcagaag agccgggggcaggccccgagattgctcatctatgccgcgagcaccagggcaaccggaattcctgcc cggttttccggttccgggtcggcactgagttcaccctgacaatcagctcaatgcagtccgaggat ttcgctgtgtacttctgtcaacagtaccacacctggcctcccctgacgttcggaggcggaaccaag gtcgaaatcaagacc |
| CAR22-32 soluble scFv NT | 390 | atggccctcccctgtcaccgccctgctgcttccgctggctcttctgctccacgccgctcggcccaa gtccaactcgtccagtccggtgcagaagtcaagaaaccaggagcttcagtgaaagtgtcgtgcaag gcctccgggtataccttcacttcctacggcattagctgggtgcggcaggccccccggccaagggctg gagtggatgggctggatcagcgcctacaacggaaacaccaactacgcccagaagctgcagggacgc gtgaccatgaccactgacacctccacttcgaccgcgtacatggagctcagatcactgcgctccgac gataccgccgtgtactactgcgcctccttctcctcctccgactcctacgactactggggacaggggg actctggtcactgtgtcgtccggcggcggcggaagcggtggcggaggcagcggtggaggcggttcg ggaggaggagggtccgaaatcgtgctgacccagtccccgctaccctttccgtgagcccgggggaa cgggccaccctgtcttgccgcgcgtcacaaagcgtgacttcgaacctggcctggtaccagcagaag ccgggggcaggccccgagattgctcatctatgccgcgagcaccagggcaaccggaattcctgcc ttttccggttccgggtcggcactgagttcaccctgacaatcagctcaatgcagtccgaggatttc gctgtgtacttctgtcaacagtaccacacctggcctcccctgacgttcggaggcggaaccaaggtc gaaatcaagaccggatcgcaccaccatcaccatcatcac |
| CAR22-32 soluble scFv AA | 391 | Malpvtalllplalllhaarpqvqlvqsgaevkkpgasvkvsckasgytftsygiswvrqapgqgl ewmgwisayngntnyaqklqgrvtmttdtststaymelrslrsddtavyycasfsssdsydywgqg tlvtvssggggsggggsggggsggggseivltqspatlsvspgeratlscrasqsvtsnlawyqqk pgqaprlliyaastratgiparfsgsgsgteftltissmqsedfavyfcqqyhtwppltfgggtkv eiktgshhhhhhhh |
| CAR22-32 Full AA | 392 | malpvtalllplalllhaarpqvqlvqsgaevkkpgasvkvsckasgytftsygiswvrqapgqgl ewmgwisayngntnyaqklqgrvtmttdtststaymelrslrsddtavyycasfsssdsydywgqg tlvtvssggggsggggsggggsggggseivltqspatlsvspgeratlscrasqsvtsnlawyqqk pgqaprlliyaastratgiparfsgsgsgteftltissmqsedfavyfcqqyhtwppltfgggtkv eikttttpaprpptpaptiasqplslrpeacrpaaggavhtrgldfacdiyiwaplagtcgvlllsl vitlyckrgrkkllyifkqpfmrpvqttqeedgcscrfpeeeeggcelrvkfsrsadapaykqgqn qlynelnlgrreeydvldkrrgrdpemggkprrknpqeglynelqkdkmaeayseigmkgerrrgk ghdglyqglstatkdtydalhmqalppr |
| CAR22-32 Full NT | 393 | atggccctcccctgtcaccgccctgctgcttccgctggctcttctgctccacgccgctcggcccaa gtccaactcgtccagtccggtgcagaagtcaagaaaccaggagcttcagtgaaagtgtcgtgcaag |

TABLE 6A-continued

Human CD22 CAR Constructs

| Name | SEQ ID | Sequence |
|---|---|---|
| | | gcctccgggtataccttcacttcctacggcattagctgggtgcggcaggcccccggccaagggctg<br>gagtggatgggctggatcagcgcctacaacggaaacaccaactacgcccagaagctgcagggacgc<br>gtgaccatgaccactgacacctccacttcgaccgcgtacatggagctcagatcactgcgctccgac<br>gataccgccgtgtactactgcgcctccttctcctcctccgactcctacgactactggggacagggg<br>actctggtcactgtgtcgtccggcggcggcggaagcggttcgggtggaggcagcggtggaggttcg<br>ggaggaggaggggtccgaaatcgtgctgacccagtcccccgctacccttccgtgagcccggggaa<br>cgggccaccctgtcttgccgcgcgtcacaaagcgtgacttcgaacctggcctggtaccagcagaag<br>ccgggggcaggccccgagattgctcatctatgccgcgagcaccagggcaaccggaattcctgcccgg<br>ttttccggttccgggtcgggcactgagttcacccctgacaatcagctcaatgcagtccgaggatttc<br>gctgtgtacttctgtcaacagtaccacacctggcctcccctgacgttcggaggcggaaccaaggtc<br>gaaatcaagaccactaccccagcaccgaggccacccaccccggctcctaccatcgcctcccagcct<br>ctgtccctgcgtccggaggcatgtagaccgcagctggtggggccgtgcatacccggggtcttgac<br>ttcgcctgcgatatctacatttgggccctctggctggtacttgcggggtcctgctgctttcactc<br>gtgatcactctttactgtaagcgcggtcggaagaagctgctgtacatctttaagcaaccctttcatg<br>aggcctgtcagactactcaagaggaggacggctgttcatgccggttcccagaggaggaggaaggc<br>ggctgcgaactgcgcgtgaaattcagccgcagcgcagatgctccagcctacaagcaggggcagaac<br>cagctctacaacgaactcaatcttggtcggagagaggagtacgacgtgctggacaagcggaggga<br>cgggacccagaaatgggcgggaagccgcgcagaaagaatcccaagagggcctgtacaacgagctc<br>caaaaggataagatggcagaagcctatagcgagattggtatgaaaggggaacgcagaagaggcaaa<br>ggccacgacggactgtaccagggactcagcaccgccaccaaggacacctatgacgctcttcacatg<br>caggccctgccgcctcgg |
| CAR22-33<br>scFv AA | 394 | qvnlresgpalvkptqtltltctfsgfslntfgmsvswirqppgkalewlalidwdddkyystslr<br>trltiskdtaknqvvlrmtnmdpmdtatyycariyggdrtntqapyffdlwgqgtlvtvssggggs<br>ggggsggggsdvvmtqsplslpvtpgepasiscrssqsllhsngynyldwylqkpgqspqlliylg<br>snrasgvpdrfsgsgsgtdftlkisrveaedvgvyycmqalqtpwtfgqgtkleik |
| CAR22-33<br>scFv NT | 395 | caagtcaacctcagagaatcaggtcctgccctcgtcaaacctacccagaccctcaccttgacctgt<br>accttctccgggttctcgctgaacaccttcgggatgtccgtgagctggattaggcagcccccggga<br>aaggccctggagtggctggccctgatcgattgggatgacgacaagtactactccacctcactccgc<br>actcgcctgaccatctcaaaggacactgccaagaaccaagtggtgctgcggatgactaacatggac<br>ccgatggacaccgccacctattactgcgcccggatctacggaggcgacagaaccaacactcaggcc<br>ccctacttcttcgatctgtggggacagggcactcttgtgaccgtgtcctcgggcggaggaggctcc<br>ggtggaggggatcaggaggaggcggcagcgacgtcgtgatgactcaatccccgctgtccttgcct<br>gtgacccctggcgaacccgcgtccattagctgccggagcagccagtccctcctgcactcgaacgga<br>tacaactacctggattggtatctgcagaagcccggccagtccccacaactcctgatctacctgggc<br>tctaatcgggcatccggggtcccggatcgcttcagcggttcgggctcgggtaccgacttcacgctg<br>aagatttccagggtggaagctgaggacgtgggagtgtactactgcatgcaggcgcttcagactcca<br>tggacatttggacaggggaccaagctggagatcaag |
| CAR22-33-<br>soluble scFv<br>NT | 396 | atggcccctcctgtcaccgccctgctgcttccgctggctcttctgctccacgccgctcggccccaa<br>gtcaacctcagagaatcaggtcctgccctcgtcaaacctacccagaccctcaccttgacctgtacc<br>ttctccgggttctcgctgaacaccttcgggatgtccgtgagctggattaggcagcccccgggaaag<br>gccctggagtggctggccctgatcgattgggatgacgacaagtactactccacctcactccgcact<br>cgcctgaccatctcaaaggacactgccaagaaccaagtggtgctgcggatgactaacatggacccg<br>atggacaccgccacctattactgcgcccggatctacggaggcgacagaaccaacactcaggccccc<br>tacttcttcgatctgtggggacagggcactcttgtgaccgtgtcctcgggcggaggaggctccggt<br>ggaggggatcaggaggaggcggcagcgacgtcgtgatgactcaatccccgctgtccttgcctgtg<br>accccttggcgaacccgcgtccattagctgccggagcagccagtccctcctgcactcgaacggatac<br>aactacctggattggtatctgcagaagcccggccagtccccacaactcctgatctacctgggctct<br>aatcgggcatccggggtcccggatcgcttcagcggttcgggctcgggtaccgacttcacgctgaag<br>atttccagggtggaagctgaggacgtgggagtgtactactgcatgcaggcgcttcagactccatgg<br>acatttggacaggggaccaagctggagatcaagggatcgcaccaccatcaccatcatcac |
| CAR22-33<br>soluble scFv<br>AA | 397 | malpvtalllplalllhaarpqvnlresgpalvkptqtltltctfsgfslntfgmsvswirqppgk<br>alewlalidwdddkyystslrtrltiskdtaknqvvlrmtnmdpmdtatyycariyggdrtntqap<br>yffdlwgqgtlvtvssggggsggggsggggsdvvmtqsplslpvtpgepasiscrssqsllhsngy<br>nyldwylqkpgqspqlliylgsnrasgvpdrfsgsgsgtdftlkisrveaedvgvyycmqalqtpw<br>tfgqgtkleikgshhhhhhhh |
| CAR22-33<br>Full AA | 398 | malpvtalllplalllhaarpqvnlresgpalvkptqtltltctfsgfslntfgmsvswirqppgk<br>alewlalidwdddkyystslrtrltiskdtaknqvvlrmtnmdpmdtatyycariyggdrtntqap<br>yffdlwgqgtlvtvssggggsggggsggggsdvvmtqsplslpvtpgepasiscrssqsllhsngy<br>nyldwylqkpgqspqlliylgsnrasgvpdrfsgsgsgtdftlkisrveaedvgvyycmqalqtpw<br>tfgqgtkleiktttpaprpptpaptiasqplslrpeacrpaaggavhtrgldfacdiyiwaplagt<br>cgvllllslvitlyckrgrkkllyifkqpfmrpvqttqeedgcscrfpeeeeggcelrvkfsrsada<br>paykqgqnqlynelnlgrreeydvldkrrgrdpemggkprrknpqeglynelqkdkmaeayseigm<br>kgerrrgkghdglyqglstatkdtydalhmqalppr |
| CAR22-33<br>Full NT | 399 | atggcccctcctgtcaccgccctgctgcttccgctggctcttctgctccacgccgctcggccccaa<br>gtcaacctcagagaatcaggtcctgccctcgtcaaacctacccagaccctcaccttgacctgtacc<br>ttctccgggttctcgctgaacaccttcgggatgtccgtgagctggattaggcagcccccgggaaag<br>gccctggagtggctggccctgatcgattgggatgacgacaagtactactccacctcactccgcact<br>cgcctgaccatctcaaaggacactgccaagaaccaagtggtgctgcggatgactaacatggacccg<br>atggacaccgccacctattactgcgcccggatctacggaggcgacagaaccaacactcaggccccc<br>tacttcttcgatctgtggggacagggcactcttgtgaccgtgtcctcgggcggaggaggctccggt |

TABLE 6A-continued

Human CD22 CAR Constructs

| Name | SEQ ID | Sequence |
|---|---|---|
| | | ggaggggatcaggaggaggcggcagcgacgtcgtgatgactcaatccccgctgtccttgcctgtg<br>accctggcgaaccgcgtccattagctgccggagcagccagtccctcctgcactcgaacggatac<br>aactacctggattggtatctgcagaagcccggccagtccccacaactcctgatctacctgggctct<br>aatcgggcatccggggtcccggatcgcttcagcggttcgggctcgggtaccgacttcacgctgaag<br>atttccagggtggaagctgaggacgtgggagtgtactactgcatgcaggcgcttcagactccatgg<br>acatttggacagggacccaagctggagatcaagaccactaccccagcaccgaggccacccaccccg<br>gctcctaccatcgcctcccagcctctgtccctgcgtccggaggcatgtagacccgcagctggtggg<br>gccgtgcatacccggggtcttgacttcgcctgcgatatctacatttgggcccctctggctggtact<br>tgcgggggtcctgctgctttcactcgtgatcactctttactgtaagcgcggtcggaagaagctgctg<br>tacatctttaagcaaccccttcatgaggcctgtgcagactactcaagaggaggacggctgttcatgc<br>cggttcccagaggaggaggaaggcggctgcgaactgcgcgtgaaattcagccgcagcgcagatgct<br>ccagcctacaagcaggggcagaaccagctctacaacgaactcaatcttggtcggagagaggagtac<br>gacgtgctggacaagcggagagacgggacccagaaatgggcgggaagccgcgcagaaaataccc<br>caagagggcctgtacaacgagctccaaaaggataagatggcagaagcctatagcgagattggtatg<br>aaaggggaacgcagaagaggcaaaggccacgacggactgtaccagggactcagcaccgccaccaag<br>gacacctatgacgctcttcacatgcaggccctgccgcctcgg |
| CAR22-34 scFv AA | 400 | qvqlqesgpglvkpsgtlsltcavsgasitsrhwwnwvrhspgkglewigqiyhsgtttynpslgs<br>rvtisvdksknqislelrsvtaadtatyycvrdylelatyygmdvwgqgttvtvssggggsggggs<br>ggggseivltqsplslpvtpgepasiscrssqsllysdgynyldwylqkpgqspqlliylgsnras<br>gvpdrfsgsgsgtdftlqisgvetedvgvyycmqalqtqsfgqgtkleik |
| CAR22-34 scFv NT | 401 | caagtgcagcttcaagaatcaggacctggcctcgtcaaaccctccggtaccctctcctcacctgt<br>gccgtgtccggggcatctatcacctcccgccactggtggaactgggtcagacactccccgggaaag<br>ggattggagtggattggccagatctaccattccggcaccactacttacaaccctcccgggctcc<br>cgcgtcactatctccgtggacaagtccaagaatcagattagcctggagctgcggtccgtgaccgct<br>gccgataccgcgacctattactgcgtgcgggactacctggagctcgccacgtactacggaatggac<br>gtctggggccagggcactaccgtgaccgtgtcaagcggggggggcggatcgggtggtggaggatcg<br>ggaggaggaggtcggaaatcgtgctgactcagtccccctgtcgctgcctgtgactcctggggaa<br>ccagcctcaattagctgccgctcgagccagtccctgctgtattccgacggatacaactacctggat<br>tggtaccttcaaaagcccggccagagcccgcagctgctgatctacctgggttcaaacagggcctcc<br>ggcgtgccggatcggttctcgggaagcggtagcgggacagacttcacctgcaaatcagcggagtg<br>gaaactgaggacgtgggcgtgtactactgcatgcaggcgttgcagacccagtcctttggacaaggc<br>accaagctcgaaatcaag |
| CAR22-34 soluble scFv NT | 402 | atggcccctcccgtcaccgccctgctgcttccgctggctcttctgctccacgccgctcggccccaa<br>gtgcagcttcaagaatcaggacctggcctcgtcaaaccctccggtaccctctcctcacctgtgcc<br>gtgtccggggcatctatcacctcccgccactggtggaactgggtcagacactccccgggaaaggga<br>ttggagtggattggccagatctaccattccggcaccactacttacaaccctcccgggctcccgc<br>gtcactatctccgtggacaagtccaagaatcagattagcctggagctgcggtccgtgaccgctgcc<br>gataccgcgacctattactgcgtgcgggactacctggagctcgccacgtactacggaatggacgtc<br>tggggccagggcactaccgtgaccgtgtcaagcggggggggcggatcgggtggtggaggatcggga<br>ggaggaggtcggaaatcgtgctgactcagtccccctgtcgctgcctgtgactcctggggaacca<br>gcctcaattagctgccgctcgagccagtccctgctgtattccgacggatacaactacctggattgg<br>taccttcaaaagcccggccagagcccgcagctgctgatctacctgggttcaaacagggcctccggc<br>gtgccggatcggttctcgggaagcggtagcgggacagacttcacctgcaaatcagcggagtggaa<br>actgaggacgtgggcgtgtactactgcatgcaggcgttgcagacccagtcctttggacaaggcacc<br>aagctcgaaatcaagggatcgcaccaccatcaccatcatcac |
| CAR22-34 soluble scFv AA | 403 | Malpvtalllplalllhaarpqvqlqesgpglvkpsgtlsltcavsgasitsrhwwnwvrhspgkg<br>lewigqiyhsgtttynpslgsrvtisvdksknqislelrsvtaadtatyycvrdylelatyygmdv<br>wgqgttvtvssggggsggggsggggseivltqsplslpvtpgepasiscrssqsllysdgynyldw<br>ylqkpgqspqlliylgsnrasgvpdrfsgsgsgtdftlqisgvetedvgvyycmqalqtqsfgqgt<br>kleikgshhhhhhhh |
| CAR22-34 Full AA | 404 | malpvtalllplalllhaarpqvqlqesgpglvkpsgtlsltcavsgasitsrhwwnwvrhspgkg<br>lewigqiyhsgtttynpslgsrvtisvdksknqislelrsvtaadtatyycvrdylelatyygmdv<br>wgqgttvtvssggggsggggsggggseivltqsplslpvtpgepasiscrssqsllysdgynyldw<br>ylqkpgqspqlliylgsnrasgvpdrfsgsgsgtdftlqisgvetedvgvyycmqalqtqsfgqgt<br>kleiktttpaprrpptpaptiasqplslrpeacrpaaggavhtrgldfacdiyiwaplagtcgvlll<br>slvitlyckrgrkkllyifkqpfmrpvqttqeedgcscrfpeeeeggcelrvkfsrsadapaykqg<br>qnqlynelnlgrreeydvldkrrgrdpemggkprrknpqeglynelqkdkmaeayseigmkgerrr<br>gkghdglyqglstatkdtydalhmqalppr |
| CAR22-34 Full NT | 405 | atggcccctcccgtcaccgccctgctgcttccgctggctcttctgctccacgccgctcggccccaa<br>gtgcagcttcaagaatcaggacctggcctcgtcaaaccctccggtaccctctcctcacctgtgcc<br>gtgtccggggcatctatcacctcccgccactggtggaactgggtcagacactccccgggaaaggga<br>ttggagtggattggccagatctaccattccggcaccactacttacaaccctcccgggctcccgc<br>gtcactatctccgtggacaagtccaagaatcagattagcctggagctgcggtccgtgaccgctgcc<br>gataccgcgacctattactgcgtgcgggactacctggagctcgccacgtactacggaatggacgtc<br>tggggccagggcactaccgtgaccgtgtcaagcggggggggcggatcgggtggtggaggatcggga<br>ggaggaggtcggaaatcgtgctgactcagtccccctgtcgctgcctgtgactcctggggaacca<br>gcctcaattagctgccgctcgagccagtccctgctgtattccgacggatacaactacctggattgg<br>taccttcaaaagcccggccagagcccgcagctgctgatctacctgggttcaaacagggcctccggc<br>gtgccggatcggttctcgggaagcggtagcgggacagacttcacctgcaaatcagcggagtggaa<br>actgaggacgtgggcgtgtactactgcatgcaggcgttgcagacccagtcctttggacaaggcacc |

TABLE 6A-continued

Human CD22 CAR Constructs

| Name | SEQ ID | Sequence |
|---|---|---|
| | | aagctcgaaatcaagaccactaccccagcaccgaggccacccaccccggctcctaccatcgcctcc
cagcctctgtccctgcgtccggaggcatgtagacccgcagctggtggggccgtgcatacccggggt
cttgacttcgcctgcgatatctacatttgggcccctctggctggtacttgcggggtcctgctgctt
tcactcgtgatcactctttactgtaagcgcggtcggaagaagctgctgtacatctttaagcaaccc
ttcatgaggcctgtgcagactactcaagaggaggacggctgttcatgccggttcccagaggaggag
gaaggcggctgcgaactgcgcgtgaaattcagccgcagcgcagatgctccagcctacaagcagggg
cagaaccagctctacaacgaactcaatcttggtcggagagaggagtacgacgtgctggacaagcgg
agaggacgggacccagaaatgggcgggaagccgcgcagaaagaatccccaagagggcctgtacaac
gagctccaaaaggataagatggcagaagcctatagcgagattggtatgaaagggaacgcagaaga
ggcaaaggccacgacggactgtaccagggactcagcaccgccaccaaggacacctatgacgctctt
cacatgcaggccctgccgcctcgg |
| CAR22-35 scFv AA | 406 | qvqlvqsgaevkkpgasvkvsckasgytftsyymhwvrqapgqglewmgiinpsggstsyaqkfqg
rvtmtrdtststvymelsslrsedtavyycardlaaagnyyyygmdvwgqgttvtvssggggsggg
gsggggssseltqdpavsvalgqtaritcqgdslrsyftswyhqkpgqapvlviygnnnrpsgipd
rfsgsssgntasltitgqaedegdyycdsrdssgdhlvfgggtkltvl |
| CAR22-35 scFv NT | 407 | caagtccaactcgtccagtccggtgcagaagtcaagaaaccaggagcttcagtgaaagtgtcgtgc
aaggcctccggctataccttcacctcctactacatgcactgggtgcgccaggcccccgggccaggga
ctggagtggatgggaattatcaaccctttcgggcggctccactagctacgcccaaaagtttcagggg
agagtgaccatgactcgggacacctcaacctcgaccgtgtacatggaactgtcgtcactgcggtcc
gaggacaccgccgtgtactactgcgcgcgcgacttggccgccgcggggaattactactactacgga
atggatgtctggggacagggaaccactgtgactgtgtcgtctggtggtggtggaagcgggggagga
ggttcgggcggcggcggaagctcctccgaactgacccaggaccctgcggtgtccgtggccctggga
cagaccgcaaggatcacgtgtcagggagacagcctccgctcctacttcacatcctggtatcatcag
aagcccggccaggctccggtgctggtcatctacggaaacaacaacagaccgtccgggattcccgac
cggttcagcggctcctcatccggcaacaccgcctccctgaccatcaccggcgcccaggccgaggac
gagggagattactactgcgactcccgggatagcagcggcgatcacctcgtgttcggggagggact
aagcttactgtgctg |
| CAR22-35 soluble scFv NT | 408 | atggccctccctgtcaccgccctgctgcttccgctggctcttctgctccacgccgctcggccccaa
gtccaactcgtccagtccggtgcagaagtcaagaaaccaggagcttcagtgaaagtgtcgtgcaag
gcctccggctataccttcacctcctactacatgcactgggtgcgccaggcccccgggccagggactg
gagtggatgggaattatcaaccctttcgggcggctccactagctacgcccaaaagtttcagggggaga
gtgaccatgactcgggacacctcaacctcgaccgtgtacatggaactgtcgtcactgcggtccgag
gacaccgccgtgtactactgcgcgcgcgacttggccgccgcggggaattactactactacggaatg
gatgtctggggacagggaaccactgtgactgtgtcgtctggtggtggtggaagcgggggaggaggt
tcgggcggcggcggaagctcctccgaactgacccaggaccctgcggtgtccgtggccctgggacag
accgcaaggatcacgtgtcagggagacagcctccgctcctacttcacatcctggtatcatcagaag
cccggccaggctccggtgctggtcatctacggaaacaacaacagaccgtccgggattcccgaccgg
ttcagcggctcctcatccggcaacaccgcctccctgaccatcaccggcgcccaggccgaggacgag
ggagattactactgcgactcccgggatagcagcggcgatcacctcgtgttcggggagggactaag
cttactgtgctgggatcgcaccaccatcaccatcatcac |
| CAR22-35 soluble scFv AA | 409 | malpvtalllplalllhaarpqvqlvqsgaevkkpgasvkvsckasgytftsyymhwvrqapgqgl
ewmgiinpsggstsyaqkfqgrvtmtrdtststvymelsslrsedtavyycardlaaagnyyyygm
dvwgqgttvtvssggggsggggsggggssseltqdpavsvalgqtaritcqgdslrsyftswyhqk
pgqapvlviygnnnrpsgipdrfsgsssgntasltitgqaedegdyycdsrdssgdhlvfgggtk
ltvlgshhhhhh |
| CAR22-35 Full AA | 410 | malpvtalllplalllhaarpqvqlvqsgaevkkpgasvkvsckasgytftsyymhwvrqapgqgl
ewmgiinpsggstsyaqkfqgrvtmtrdtststvymelsslrsedtavyycardlaaagnyyyygm
dvwgqgttvtvssggggsggggsggggssseltqdpavsvalgqtaritcqgdslrsyftswyhqk
pgqapvlviygnnnrpsgipdrfsgsssgntasltitgqaedegdyycdsrdssgdhlvfgggtk
ltvltttpaprpptpaptiasqplslrpeacrpaaggavhtrgldfacdiyiwaplagtcgvllls
lvitlyckrgrkkllyifkqpfmrpvqttqeedgcscrfpeeeeggcelrvkfsrsadapaykqgq
nqlynelnlgrreeydvldkrrgrdpemggkprrknpqeglynelqkdkmaeayseigmkgerrrg
khdglyqglstatkdtydalhmqalppr |
| CAR22-35 Full NT | 411 | atggccctccctgtcaccgccctgctgcttccgctggctcttctgctccacgccgctcggccccaa
gtccaactcgtccagtccggtgcagaagtcaagaaaccaggagcttcagtgaaagtgtcgtgcaag
gcctccggctataccttcacctcctactacatgcactgggtgcgccaggcccccgggccagggactg
gagtggatgggaattatcaaccctttcgggcggctccactagctacgcccaaaagtttcagggggaga
gtgaccatgactcgggacacctcaacctcgaccgtgtacatggaactgtcgtcactgcggtccgag
gacaccgccgtgtactactgcgcgcgcgacttggccgccgcggggaattactactactacggaatg
gatgtctggggacagggaaccactgtgactgtgtcgtctggtggtggtggaagcgggggaggaggt
tcgggcggcggcggaagctcctccgaactgacccaggaccctgcggtgtccgtggccctgggacag
accgcaaggatcacgtgtcagggagacagcctccgctcctacttcacatcctggtatcatcagaag
cccggccaggctccggtgctggtcatctacggaaacaacaacagaccgtccgggattcccgaccgg
ttcagcggctcctcatccggcaacaccgcctccctgaccatcaccggcgcccaggccgaggacgag
ggagattactactgcgactcccgggatagcagcggcgatcacctcgtgttcggggagggactaag
cttactgtgctgaccactaccccagcaccgaggccacccaccccggctcctaccatcgcctcccag
cctctgtccctgcgtccggaggcatgtagacccgcagctggtggggccgtgcatacccggggtctt
gacttcgcctgcgatatctacatttgggcccctctggctggtacttgcggggtcctgctgctttca
ctcgtgatcactctttactgtaagcgcggtcggaagaagctgctgtacatctttaagcaaccctc
atgaggcctgtgcagactactcaagaggaggacggctgttcatgccggttcccagaggaggagaa |

TABLE 6A-continued

Human CD22 CAR Constructs

| Name | SEQ ID | Sequence |
|---|---|---|
| | | ggcggctgcgaactgcgcgtgaaattcagccgcagcgcagatgctccagcctacaagcaggggcag aaccagctctacaacgaactcaatcttggtcggagagaggagtacgacgtgctggacaagcggaga ggacgggacccagaaatgggcgggaagccgcgcagaaagaatccccaagagggcctgtacaacgag ctccaaaaggataagatggcagaagcctatagcgagattggtatgaaaggggaacgcagaagaggc aaaggccacgacggactgtaccagggactcagcaccgccaccaaggacacctatgacgctcttcac atgcaggccctgccgcctcgg |
| CAR22-36 scFv AA | 412 | Qvqlvqsgaevkkpgasvkvsckasgytftsyymhwvrqapgqglewmgiinpsggstsyaqkfqg rvtmtrdtststvymelsslrsedtavyycardddfwsgsgafdiwgqgttvtvssggggsggggs ggggssseltqdpavsvalgqtvritcqgdslrsyyaswyqqkpgqapvlviygknnrpsgipdrf sgsssgntasltitgaqaedeadyycnsrdssgnhpvvfgggtkltvl |
| CAR22-36 scFv NT | 413 | caagtccaactcgtccaatccggtgcagaagtcaagaaacctggagcttccgtgaaagtgtcctgc aaggcgtcaggctacacctttacgtcctactacatgcactgggtccgccaggcccccgggccagggc ttggagtggatgggaatcattaaccccagcggcggcagcactagctatgcccagaagttccagggt cgggtcaccatgactagagacacatccacctccaccgtgtacatggaactgagctccctgcggtcc gaggataccgcggtgtactactgcgcccgcgatgacgacttctggtccggctcggggcgcattcgac atctggggacagggcaccaccgtgactgtgtcctccggcggtggaggatcgggtggcggaggaagc ggtggaggcggatcttcgtccgaactgactcaggaccctgccgtgtcggtggccctgggacagact gtgcgcatcacctgtcaaggagatagcctgaggtcgtactatgcctcctggtaccagcagaagccc ggacaggccccggtgcttgtgatctacgggaagaacaacagaccgtcagggattccagaccggttc agcgggtcatccagcgggaataccgcttccctcactatcaccggagcccaggcggaggacgaggcc gattactactgcaactcgcgggactcatccggcaaccatcccgtggtgttcggaggggggcactaag ctgaccgtgctg |
| CAR22-36 soluble scFv NT | 414 | atggccctccctgtcaccgccctgctgcttccgctggctcttctgctccacgccgctcggccccaa gtccaactcgtccaatccggtgcagaagtcaagaaacctggagcttccgtgaaagtgtcctgcaag gcgtcaggctacacctttacgtcctactacatgcactgggtccgccaggcccccgggccagggcttg gagtggatgggaatcattaaccccagcggcggcagcactagctatgcccagaagttccagggtcgg gtcaccatgactagagacacatccacctccaccgtgtacatggaactgagctccctgcggtccgag gataccgcggtgtactactgcgcccgcgatgacgacttctggtccggctcggggggcattcgacatc tggggacagggcaccaccgtgactgtgtcctccggcggtggaggatcgggtggcggaggaagcggt ggaggcggatcttcgtccgaactgactcaggaccctgccgtgtcggtggccctgggacagactgtg cgcatcacctgtcaaggagatagcctgaggtcgtactatgcctcctggtaccagcagaagcccgga caggccccggtgcttgtgatctacgggaagaacaacagaccgtcagggattccagaccggttcagc gggtcatccagcgggaataccgcttccctcactatcaccggagcccaggcggaggacgaggccgat tactactgcaactcgcgggactcatccggcaaccatcccgtggtgttcggaggggggcactaagctg accgtgctgggatcgcaccaccatcaccatcatcac |
| CAR22-36 soluble scFv AA | 415 | malpvtalllplalllhaarpqvqlvqsgaevkkpgasvkvsckasgytftsyymhwvrqapgqgl ewmgiinpsggstsyaqkfqgrvtmtrdtststvymelsslrsedtavyycardddfwsgsgafdi wgqgttvtvssggggsggggsggggssseltqdpavsvalgqtvritcqgdslrsyyaswyqqkpg qapvlviygknnrpsgipdrfsgsssgntasltitgaqaedeadyycnsrdssgnhpvvfgggtkl tvlgshhhhhhhh |
| CAR22-36 Full AA | 416 | malpvtalllplalllhaarpqvqlvqsgaevkkpgasvkvsckasgytftsyymhwvrqapgqgl ewmgiinpsggstsyaqkfqgrvtmtrdtststvymelsslrsedtavyycardddfwsgsgafdi wgqgttvtvssggggsggggsggggssseltqdpavsvalgqtvritcqgdslrsyyaswyqqkpg qapvlviygknnrpsgipdrfsgsssgntasltitgaqaedeadyycnsrdssgnhpvvfgggtkl tvltttpaprpptpaptiasqplslrpeacrpaaggavhtrgldfacdiyiwaplagtcgvlllsl vitlyckrgrkkllyifkqpfmrpvqttqeedgcscrfpeeeeggcelrvkfsrsadapaykqgqn qlynelnlgrreeydvldkrrgrdpemggkprrknpqeglynelqkdkmaeayseigmkgerrrgk ghdglyqglstatkdtydalhmqalppr |
| CAR22-36 Full NT | 417 | atggccctccctgtcaccgccctgctgcttccgctggctcttctgctccacgccgctcggccccaa gtccaactcgtccaatccggtgcagaagtcaagaaacctggagcttccgtgaaagtgtcctgcaag gcgtcaggctacacctttacgtcctactacatgcactgggtccgccaggcccccgggccagggcttg gagtggatgggaatcattaaccccagcggcggcagcactagctatgcccagaagttccagggtcgg gtcaccatgactagagacacatccacctccaccgtgtacatggaactgagctccctgcggtccgag gataccgcggtgtactactgcgcccgcgatgacgacttctggtccggctcggggggcattcgacatc tggggacagggcaccaccgtgactgtgtcctccggcggtggaggatcgggtggcggaggaagcggt ggaggcggatcttcgtccgaactgactcaggaccctgccgtgtcggtggccctgggacagactgtg cgcatcacctgtcaaggagatagcctgaggtcgtactatgcctcctggtaccagcagaagcccgga caggccccggtgcttgtgatctacgggaagaacaacagaccgtcagggattccagaccggttcagc gggtcatccagcgggaataccgcttccctcactatcaccggagcccaggcggaggacgaggccgat tactactgcaactcgcgggactcatccggcaaccatcccgtggtgttcggaggggggcactaagctg accgtgctgaccactacccccagcaccgaggccacccaccccggcctcctaccatcgcctcccagcct ctgtccctcgtccggaggcatgtagacccgcagctggtggggccgtgcatacccggggtcttgac ttcgcctgcgatatctactatttgggcccctctggctggtacttgcggggtcctgctgctttcactc gtgatcactcttttactgtaagcgcggtcggaagaagctgcttgtacatctttaagcaaccttcatg aggcctgtgcagactactcaagaggaggacggctgttcatgccggttcccagagagggaggaaggc ggctgcgaactgcgcgtgaaattcagccgcagcgcagatgctccagcctacaagcaggggcagaac cagctctacaacgaactcaatcttggtcggagagaggagtacgacgtgctggacaagcggagagga cgggacccagaaatgggcgggaagccgcgcagaaagaatccccaagagggcctgtacaacgagctc caaaaggataagatggcagaagcctatagcgagattggtatgaaaggggaacgcagaagaggcaaa |

TABLE 6A-continued

Human CD22 CAR Constructs

| Name | SEQ ID | Sequence |
|---|---|---|
| | | ggccacgacggactgtaccagggactcagcaccgccaccaaggacacctatgacgctcttcacatg<br>caggccctgccgcctcgg |
| CAR22-37<br>scFv AA | 418 | qvqlvqsgaevkkpgasvkvsckasgytftsyymhwvrqapgqglewmgiinpsggstsyaqkfqg<br>rvtmtrdtststvymelsslrsedtavyycarpegvsyydssvldywgqgtlvtvssggggsggggs<br>sggggsqsaltqpasvsgspgqsitisctgtssdvggykhvswyqhhpgkapklmiydvsnrpsgv<br>snrfsgsksgntasltvsglqaedeahyycvsyrnfnslvfgtgtkvtvl |
| CAR22-37<br>scFv NT | 117 | caagtccaactcgtccagtccggtgcagaagtcaagaaacccggagcttccgtgaaagtgtcctgc<br>aaggcctcggggtataccttcacttcctactacatgcactgggtccggcaggcgccgggacaggga<br>ctggaatggatgggtatcatcaaccctcgggcggttccactagctacgcccagaagttccaggga<br>agagtgaccatgacccgggacacttccacttcgaccgtgtacatggaactgagcagcctgaggagc<br>gaggacaccgccgtgtactactgtgcccggcccgaggagtgtcctactacgattcctccgtgctg<br>gattactggggacagggaacacttgtgaccgtgtcctcgggaggaggcggaagcggggcggaggg<br>tctgggggaggcggctccagtccgctctgacgcagcctgcgtccgtgtccgggagccctggccag<br>agcattactatttcatgcaccggtaccagctccgacgtgggcggataaagcacgtgtcatggtac<br>cagcatcacccgggaaaggcccaaagctgatgatctacgacgtgtcgaacagaccgagcggggtg<br>tcaaatcgcttttccggttcaaagtcgggcaacactgcctcactcaccgtgtcgggcctccaagcg<br>gaggacgaagcccactactactgcgtgtcctaccgcaacttcaactccttggtgttcggcaccggc<br>accaaggtcaccgtcctg |
| CAR22-37<br>soluble scFv<br>NT | 419 | atggccctccctgtcaccgccctgctgcttccgctggctcttctgctccacgccgctcggccccaa<br>gtccaactcgtccagtccggtgcagaagtcaagaaacccggagcttccgtgaaagtgtcctgcaag<br>gcctcggggtataccttcacttcctactacatgcactgggtccggcaggcgccgggacagggactg<br>gaatggatgggtatcatcaaccctcgggcggttccactagctacgcccagaagttccagggaaga<br>gtgaccatgacccgggacacttccacttcgaccgtgtacatggaactgagcagcctgaggagcgag<br>gacaccgccgtgtactactgtgcccggcccgaggagtgtcctactacgattcctccgtgctggat<br>tactggggacagggaacacttgtgaccgtgtcctcgggaggaggcggaagcggggcggagggtct<br>gggggaggcggctccagtccgctctgacgcagcctgcgtccgtgtccgggagccctggccagagc<br>attactatttcatgcaccggtaccagctccgacgtgggcggataaagcacgtgtcatggtaccag<br>catcacccgggaaaggcccaaagctgatgatctacgacgtgtcgaacagaccgagcggggtgtca<br>aatcgcttttccggttcaaagtcgggcaacactgcctcactcaccgtgtcgggcctccaagcggag<br>gacgaagcccactactactgcgtgtcctaccgcaacttcaactccttggtgttcggcaccggcacc<br>aaggtcaccgtcctgggatcgcaccaccatcaccatcatcatcac |
| CAR22-37<br>soluble scFv<br>AA | 420 | Malpvtalllplalllhaarpqvqlvqsgaevkkpgasvkvsckasgytftsyymhwvrqapgqgl<br>ewmgiinpsggstsyaqkfqgrvtmtrdtststvymelsslrsedtavyycarpegvsyydssvld<br>ywgqgtlvtvssggggsggggsggggsqsaltqpasvsgspgqsitisctgtssdvggykhvswyq<br>hhpgkapklmiydvsnrpsgvsnrfsgsksgntasltvsglqaedeahyycvsyrnfnslvfgtgt<br>kvtvlgshhhhhhhh |
| CAR22-37<br>Full AA | 421 | malpvtalllplalllhaarpqvqlvqsgaevkkpgasvkvsckasgytftsyymhwvrqapgqgl<br>ewmgiinpsggstsyaqkfqgrvtmtrdtststvymelsslrsedtavyycarpegvsyydssvld<br>ywgqgtlvtvssggggsggggsggggsqsaltqpasvsgspgqsitisctgtssdvggykhvswyq<br>hhpgkapklmiydvsnrpsgvsnrfsgsksgntasltvsglqaedeahyycvsyrnfnslvfgtgt<br>kvtvltttpaprppptpaptiasqplslrpeacrpaaggavhtrgldfacdiyiwaplagtcgvlll<br>slvitlyckrgrkkllyifkqpfmrpvqttqeedgcscrfpeeeeggcelrvkfsrsadapaykqg<br>qnqlynelnlgrreeydvldkrrgrdpemggkprrknpqeglynelqkdkmaeayseigmkgerrr<br>gkghdglyqglstatkdtydalhmqalppr |
| CAR22-37<br>Full NT | 422 | atggccctccctgtcaccgccctgctgcttccgctggctcttctgctccacgccgctcggccccaa<br>gtccaactcgtccagtccggtgcagaagtcaagaaacccggagcttccgtgaaagtgtcctgcaag<br>gcctcggggtataccttcacttcctactacatgcactgggtccggcaggcgccgggacagggactg<br>gaatggatgggtatcatcaaccctcgggcggttccactagctacgcccagaagttccagggaaga<br>gtgaccatgacccgggacacttccacttcgaccgtgtacatggaactgagcagcctgaggagcgag<br>gacaccgccgtgtactactgtgcccggcccgaggagtgtcctactacgattcctccgtgctggat<br>tactggggacagggaacacttgtgaccgtgtcctcgggaggaggcggaagcggggcggagggtct<br>gggggaggcggctccagtccgctctgacgcagcctgcgtccgtgtccgggagccctggccagagc<br>attactatttcatgcaccggtaccagctccgacgtgggcggataaagcacgtgtcatggtaccag<br>catcacccgggaaaggcccaaagctgatgatctacgacgtgtcgaacagaccgagcggggtgtca<br>aatcgcttttccggttcaaagtcgggcaacactgcctcactcaccgtgtcgggcctccaagcggag<br>gacgaagcccactactactgcgtgtcctaccgcaacttcaactccttggtgttcggcaccggcacc<br>aaggtcaccgtcctgaccactacccagcaccgaggccacccaccccggctcctaccatcgcctcc<br>cagcctctgtccctgcgtccgaggcatgtagacccgcagctggtggggccgtgcatacccgggt<br>cttgacttcgcctgcgatatctacatttgggcccctctggctggtacttgcggggtcctgctgctt<br>tcactcgtgatcactctttactgtaagcgcggtcggaagaagctgctgtacatctttaagcaaccc<br>ttcatgaggcctgtgcagactactcaagaggaggacggctgttcatgccggttcccagaggaggag<br>gaaggcggctgcgaactgcgcgtgaaattcagccgcagcgcagatgctccagctacaagcagggg<br>cagaaccagctctacaacgaactcaatcttggcggagaggagtacgacgtgctggacaagcgg<br>agaggacgggacccagaaatgggcgggaagccgcgcagaaagaatccccaagagggcctgtacaac<br>gagctccaaaaggataaagtggcagaagcctatagcgagattggtatgaaggggaacgcagaaga<br>ggcaaaggccacgacggactgtaccagggactcagcaccgccaccaaggacacctatgacgctctt<br>cacatgcaggccctgccgcctcgg |
| CAR22-38<br>scFv AA | 423 | qvqlvqsgaevkkpgasvkvsckasgytftsyymhwvrqapgqglewmgiinpsggstsyaqkfqg<br>rvtmtrdtststvymelsslraedtavyycarggygdyldafdiwgqgttvtvssggggsggggsg |

TABLE 6A-continued

Human CD22 CAR Constructs

| Name | SEQ ID | Sequence |
|---|---|---|
| | | sggsqsaltqpasvsgspgqsitisctgtssdvggynyvswyqqhpgkapklmiyevsnrpsgvsn<br>rfsgsksgntasltisglqaedeadyycssytssstlvfgtgtqltvl |
| CAR22-38<br>scFv NT | 424 | caagtccaactcgtccaatccggtgcagaagtcaagaaacctggagcatccgtgaaagtgtcctgc<br>aaggcgtccgggtatacgttcacctcctactacatgcactgggtgcgccaggccccgggacaggga<br>ctggaatggatgggaatcatcaatcctagcggcggcagcaccagctacgcccagaagtttcagggc<br>cgcgtgaccatgaccagggacactagcacctccaccgtgtacatggaattgtccagcctgagagcc<br>gaggatactgctgtgtactactgcgccggggcggatacggagattatctggacgccttcgacatt<br>tggggacagggcactactgtgaccgtgtcctcgggggaggcggctcggggggcggcggatcagga<br>tcaggcggttcccagtccgcgctgacacagcccgcttccgtgagcggttcgcccgggcagtccatc<br>accatttcgtgtaccggaacttcctccgacgtcggtggctacaactacgtgtcgtggtaccagcaa<br>catccgggaaaggccccaaagctcatgatctacgaggtgtccaaccggccgtccggggtgtcaaac<br>cggttcagcggctcaaagagcggaaacaccgcctccctcaccatctcgggactgcaggccgaggat<br>gaagcggactactactgctcgagctacacttcctcatctaccctggtgttcgggactggtacccag<br>cttaccgtgctg |
| CAR22-38<br>soluble scFv<br>NT | 425 | atggccctccctgtcaccgccctgctgcttccgctggctcttctgctccacgccgctcggccccaa<br>gtccaactcgtccaatccggtgcagaagtcaagaaacctggagcatccgtgaaagtgtcctgcaag<br>gcgtccgggtatacgttcacctcctactacatgcactgggtgcgccaggccccgggacagggactg<br>gaatggatgggaatcatcaatcctagcggcggcagcaccagctacgcccagaagtttcagggccgc<br>gtgaccatgaccagggacactagcacctccaccgtgtacatggaattgtccagcctgagagccgag<br>gatactgctgtgtactactgcgccggggcggatacggagattatctggacgccttcgacatttgg<br>ggacagggcactactgtgaccgtgtcctcgggggaggcggctcggggggcggcggatcaggatca<br>ggcggttcccagtccgcgctgacacagcccgcttccgtgagcggttcgcccgggcagtccatcacc<br>atttcgtgtaccggaacttcctccgacgtcggtggctacaactacgtgtcgtggtaccagcaacat<br>ccgggaaaggccccaaagctcatgatctacgaggtgtccaaccggccgtccggggtgtcaaaccgg<br>ttcagcggctcaaagagcggaaacaccgcctccctcaccatctcgggactgcaggccgaggatgaa<br>gcggactactactgctcgagctacacttcctcatctaccctggtgttcgggactggtacccagctt<br>accgtgctgggatcgcaccaccatcaccatcatcac |
| CAR22-38<br>soluble scFv<br>AA | 426 | malpvtalllplallhaarpqvqlvqsgaevkkpgasvkvsckasgytftsyymhwvrqapgqgl<br>ewmgiinpsggstsyaqkfqgrvtmtrdtststvymelsslraedtavyycarggygdyldafdiw<br>gqgttvtvssggggsggggsggggsqsaltqpasvsgspgqsitisctgtssdvggynyvswyqqh<br>pgkapklmiyevsnrpsgvsnrfsgsksgntasltisglqaedeadyycssytssstlvfgtgtql<br>tvlgshhhhhhhh |
| CAR22-38<br>Full AA | 427 | malpvtalllplallhaarpqvqlvqsgaevkkpgasvkvsckasgytftsyymhwvrqapgqgl<br>ewmgiinpsggstsyaqkfqgrvtmtrdtststvymelsslraedtavyycarggygdyldafdiw<br>gqgttvtvssggggsggggsggggsqsaltqpasvsgspgqsitisctgtssdvggynyvswyqqh<br>pgkapklmiyevsnrpsgvsnrfsgsksgntasltisglqaedeadyycssytssstlvfgtgtql<br>tvltttpaprpptpaptiasqplslrpeacrpaaggavhtrgldfacdiyiwaplagtcgvlllsl<br>vitlyckrgrkkllyifkqpfmrpvqttqeedgcscrfpeeeeggcelrvkfsrsadapaykqgqn<br>qlynelnlgrreeydvldkrrgrdpemggkprrknpqeglynelqkdkmaeayseigmkgerrrgk<br>ghdglyqglstatkdtydalhmqalppr |
| CAR22-38<br>Full NT | 428 | atggccctccctgtcaccgccctgctgcttccgctggctcttctgctccacgccgctcggccccaa<br>gtccaactcgtccaatccggtgcagaagtcaagaaacctggagcatccgtgaaagtgtcctgcaag<br>gcgtccgggtatacgttcacctcctactacatgcactgggtgcgccaggccccgggacagggactg<br>gaatggatgggaatcatcaatcctagcggcggcagcaccagctacgcccagaagtttcagggccgc<br>gtgaccatgaccagggacactagcacctccaccgtgtacatggaattgtccagcctgagagccgag<br>gatactgctgtgtactactgcgccggggcggatacggagattatctggacgccttcgacatttgg<br>ggacagggcactactgtgaccgtgtcctcgggggaggcggctcggggggcggcggatcaggatca<br>ggcggttcccagtccgcgctgacacagcccgcttccgtgagcggttcgcccgggcagtccatcacc<br>atttcgtgtaccggaacttcctccgacgtcggtggctacaactacgtgtcgtggtaccagcaacat<br>ccgggaaaggccccaaagctcatgatctacgaggtgtccaaccggccgtccggggtgtcaaaccgg<br>ttcagcggctcaaagagcggaaacaccgcctccctcaccatctcgggactgcaggccgaggatgaa<br>gcggactactactgctcgagctacacttcctcatctaccctggtgttcgggactggtacccagctt<br>accgtgctgaccactaccccagcaccgaggccacccaccccggctcctaccatcgcctcccagcct<br>ctgtccctgcgtccggaggcatgtagacccgcagctggtggggccgtgcatacccggggtcttgac<br>ttcgcctgcgatatctacatttgggcccctctggctggtacttgcggggtcctgctgctttcactc<br>gtgatcactctttactgtaagcgcggtcggaagaagctgctgtacatctttaagcaaccttcatg<br>aggcctgtgcagactactcaagaggaggacggctgttcatgccggttcccagaggaggaggaagc<br>ggctgcgaactgcgcgtgaaattcagccgcagcgcagatgctccagcctacaagcaggggcagaac<br>cagctctacaacgaactcaatcttggtcggagagaggagtacgacgtgctggacaagcggagagga<br>cgggacccagaaatgggcgggaagccgcgcagaaagaatcccaagagggcctgtacaacgagctc<br>caaaaggataagatggcagaagcctatagcgagattggtatgaaaggggaacgcagaagaggcaaa<br>ggccacgacggactgtaccagggactcagcaccgccaccaaggacacctatgacgctcttcacatg<br>caggccctgccgcctcgg |

Several additional CD22 scFv sequences were generated and are described in Table 6B below. Clones CD22-64 and CD22-65 were based on affinity maturation of clone CD22-12 above. In some embodiments, the affinity of an affinity-matured binding domain for CD22 is stronger than that of CD22-12 for CD22. In some embodiments, the on-rate of an affinity-matured binding domain for CD22 is faster than that of CD22-12 for CD22.

TABLE 6B

Human CD22 scFv sequences

| Name | SEQ ID | Sequence |
|---|---|---|
| CAR22-53 scFv domain AA | 131 | EVQLQQSGPGLVKPSQTLSLTCAISGDSVSSNSAAWNWIRQSPSRGLEWLGRTYYRSKWYSDYAVS VKSRITINPDTSKNQFSLQLNSVTPEDTAVYYCARDPYDFWSGYPDAFDIWGQGTMVTVSSGGGGS GGGGSGGGGSQSALTQPASVSGSPGQSITISCTGTSSDVGGYNYVSWYQQHPGKAPKVIISEVNNR PSGVSHRFSGSKSGNTASLTISGLQAEDEADYFCSSYTSGRTLYVFGTGSKVTVLG |
| CAR22-53 scFv NT | 1108 | GAGGTACAGCTGCAGCAGTCAGGTCCAGGACTGGTGAAGCCCTCGCAGACCCTCTCACTCACCTGT GCCATCTCCGGGGACAGTGTCTCTAGCAACAGTGCTGCTTGGAACTGGATCAGGCAGTCCCCATCG AGAGGCCTTGAGTGGCTGGGAAGGACATACTACAGGTCCAAGTGGTATAGTGATTATGCAGTATCT GTGAAAAGTCGAATAACCATCAACCCAGACACATCCAAGAACCAGTTCTCCCTGCAGCTGAACTCT GTGACTCCCGAGGACACGGCTGTGTATTACTGTGCAAGAGATCCTTACGATTTTTGGAGTGGTTAT CCTGATGCTTTTGATATCTGGGGCCAAGGGACAATGGTCACCGTCTCTTCAGGTGGTGGTGGCAGC GGCGGCGGCGGCTCTGGTGGTGGTGGATCCCAGTCTGCCCTGACTCAGCCTGCCTCCGTGTCTGGG TCTCCTGGACAGTCGATCACCATCTCCTGCACTGGAACCAGCAGTGACGTTGGTGGTTACAACTAT GTCTCCTGGTACCAACAGCACCCAGGCAAAGCCCCCAAGGTCATAATTTCTGAGGTCAATAATCGG CCCTCAGGGGTTTCTCATCGCTTCTCTGGGTCCAAGTCTGGCAACACGGCCTCCCTGACCATCTCT GGGCTCCAGGCTGAGGACGAGGCTGATTATTTCTGCAGCTCATATACAAGTGGCAGGACTCTTTAT GTCTTCGGAACTGGGAGCAAGGTCACCGTCCTAGGT |
| CAR22-53 Full AA | 1109 | <u>MALPVTALLLPLALLLHAARP</u>EVQLQQSGPGLVKPSQTLSLTCAISGDSVSSNSAAWNWIRQSPSR GLEWLGRTYYRSKWYSDYAVSVKSRITINPDTSKNQFSLQLNSVTPEDTAVYYCARDPYDFWSGYP DAFDIWGQGTMVTVSSGGGGSGGGGSGGGGSQSALTQPASVSGSPGQSITISCTGTSSDVGGYNYV SWYQQHPGKAPKVIISEVNNRPSGVSHRFSGSKSGNTASLTISGLQAEDEADYFCSSYTSGRTLYV FGTGSKVTVLGTTTPAPRPPTPAPTIASQPLSLRPEACRPAAGGAVHTRGLDFACDIYIWAPLAGT CGVLLLSLVITLYCKRGRKKLLYIFKQPFMRPVQTTQEEDGCSCRFPEEEEGGCELRVKFSRSADA PAYKQGQNQLYNELNLGRREEYDVLDKRRGRDPEMGGKPRRKNPQEGLYNELQKDKMAEAYSEIGM KGERRRGKGHDGLYQGLSTATKDTYDALHMQALPPR |
| CAR22-53 Full NT (CD22-53 scFv + humanCD8 alpha + 41-BB + CD3zeta) | 1110 | <u>ATGGCCCTCCCTGTCACCGCCCTGCTGCTTCCGCTGGCTCTTCTGCTCCACGCCGCTCGGCCC</u>GAG GTACAGCTGCAGCAGTCAGGTCCAGGACTGGTGAAGCCCTCGCAGACCCTCTCACTCACCTGTGCC ATCTCCGGGGACAGTGTCTCTAGCAACAGTGCTGCTTGGAACTGGATCAGGCAGTCCCCATCGAGA GGCCTTGAGTGGCTGGGAAGGACATACTACAGGTCCAAGTGGTATAGTGATTATGCAGTATCTGTG AAAAGTCGAATAACCATCAACCCAGACACATCCAAGAACCAGTTCTCCCTGCAGCTGAACTCTGTG ACTCCCGAGGACACGGCTGTGTATTACTGTGCAAGAGATCCTTACGATTTTTGGAGTGGTTATCCT GATGCTTTTGATATCTGGGGCCAAGGGACAATGGTCACCGTCTCTTCAGGTGGTGGTGGCAGCGGC GGCGGCGGCTCTGGTGGTGGTGGATCCCAGTCTGCCCTGACTCAGCCTGCCTCCGTGTCTGGGTCT CCTGGACAGTCGATCACCATCTCCTGCACTGGAACCAGCAGTGACGTTGGTGGTTACAACTATGTC TCCTGGTACCAACAGCACCCAGGCAAAGCCCCCAAGGTCATAATTTCTGAGGTCAATAATCGGCCC TCAGGGGTTTCTCATCGCTTCTCTGGGTCCAAGTCTGGCAACACGGCCTCCCTGACCATCTCTGGG CTCCAGGCTGAGGACGAGGCTGATTATTTCTGCAGCTCATATACAAGTGGCAGGACTCTTTATGTC TTCGGAACTGGGAGCAAGGTCACCGTCCTAGGTACCACTACCCCAGCACCGAGGCCACCCACCCCG GCTCCTACCATCGCCTCCCAGCCTCTGTCCCTGCGTCCGGAGGCATGTAGACCCGCAGCTGGTGGG GCCGTGCATACCCGGGGTCTTGACTTCGCCTGCGATATCTACATTTGGGCCCCTCTGGCTGGTACT TGCGGGGTCCTGCTGCTTTCACTCGTGATCACTCTTTACTGTAAGCGCGGTCGGAAGAAGCTGCTG TACATCTTTAAGCAACCCTTCATGAGGCCTGTGCAGACTACTCAAGAGGAGGACGGCTGTTCATGC CGGTTCCCAGAGGAGGAGGAAGGCGGCTGCGAACTGCGCGTGAAATTCAGCCGCAGCGCAGATGCT CCAGCCTACAAGCAGGGGCAGAACCAGCTCTACAACGAACTCAATCTTGGTCGGAGAGAGGAGTAC GACGTGCTGGACAAGCGGAGAGGACGGGACCCAGAAATGGGCGGGAAGCCGCGCAGAAAGAATCCC CAAGAGGGCCTGTACAACGAGCTCCAAAAGGATAAGATGGCAGAAGCCTATAGCGAGATTGGTATG AAAGGGGAACGCAGAAGAGGCAAAGGCCACGACGGACTGTACCAGGGACTCAGCACCGCCACCAAG GACACCTATGACGCTCTTCACATGCAGGCCCTGCCGCCTCGG |
| CAR 22-57 | 132 | EVQLQQSGPGLVKPSQTLSLTCAISGDSVSNNNAAWNWIRQSPSRGLEWLGRTYHRSTWYNDYVGS VKSRITINPDTSKNQFSLQLNSVTPEDTAVYYCARETDYGDYGAFDIWGQGTTVTVSSGGGGSGGG GSGGGGSQSALTQPASVSGSPGQSITISCTGSRNDIGAYESVSWYQQHPGNAPKLIIHGVNNRPSG VFDRFSVSQSGNTASLTISGLQAEDEADYYCSSHTTTSTLYVFGTGTKVTVLG |
| CAR22-58 | 133 | EVQLQQSGPGLVNPSQTLSITCAISGDSVSSNSAAWNWIRQSPSRGLEWLGRTFYRSKWYNDYAVS VKGRITISPDTSKNQFSLQLNSVTPEDTAVYYCAGGDYYYGLDVWGQGTTVTVSSGGGGSGGGGSG GGGSQSALTQPASVSGSPGQSITISCTGSSSDVGGYNSVSWYQQHPGKAPKLMIYEVINRPSGVSH RFSGSKSGNTASLTISGLQAEDEADYYCSSYTSSSTYVFGTGTKVTVLG |
| CAR22-59 | 134 | EVQLQQSGPGLVKPSQTLSLTCAISGDSVLSNSDTWNWIRQSPSRGLEWLGRTYHRSTWYDDYASS VRGRVSINVDTSKNQYSLQLNAVTPEDTGVYYCARDRLQDGNSWSDAFDVWGQGTMVTVSSGGGGS GGGGSGGGGSQSALTQPASVSGSPGQSITISCTGSSSDIGGFNYVSWYQQHAGEAPKLMIYEVTNR PSGVSDRFSGSKSDNTASLTISGLQAEDEADYYCSSYASGSPLYVFGTGTKVTVLG |
| CAR22-60 | 135 | EVQLQQSGPGLVKPSQTLSLTCAISGDSVLSNSDTWNWIRQSPSRGLEWLGRTYHRSTWYDDYASS VRGRVSINVDTSKNQYSLQLNAVTPEDTGVYYCARDRLQDGNSWSDAFDVWGQGTMVTVSSGGGGS GGGGSGSGGSQSALTQPASVSGSPGQSITFSCTGTSSDIGGYNVSWYQQHPGKAPKLMIYEVSNR PSGVSNRFSGTKSGNTASLTISGLQAEDEADYYCSSYTSSSTLYVFGTGTKLTVLG |
| CAR22-61 | 136 | QVQLQESGPGLVKPSQTLSLTCAISGDSVLSNSDTWNWIRQSPSRGLEWLGRTYHRSTWYDDYASS VRGRVSINVDTSKNQYSLQLNAVTPEDTGVYYCARDRLQDGNSWSDAFDVWGQGTMVTVSSGGGGS GGGGSGSGGSQSALTQPASVSGSPGQSITISCTGTSSDVGGYNYVSWYQQHPGKAPKLMIYEVSNR PSGVSNRFSGSKSGNTASLTISGLQAEDEADYYCSSYTSSSTLYVFGTGTKVTVLG |

TABLE 6B-continued

Human CD22 scFv sequences

| Name | SEQ ID | Sequence |
|---|---|---|
| CAR22-62 | 137 | EVQLQQSGPGLVKPSQTLSLTCAISGDSVLSNSDTWNWIRQSPSRGLEWLGRTYHRSTWYDDYASS VRGRVSINVDTSKNQYSLQLNAVTPEDTGVYYCARDRLQDGNSWSDAFDVWGQGTMVTVSSGGGGS GGGGSGGGGSQSALTQPASVSGSPGQSITISCTGTSSDVGGYNYVSWYQQHPGKAPKLMIYDVSNR PSGVSNRFSGSKSGNTASLTISGLQAEDEADYYCSSYTSSSTLYVFGTGTKVTVLG |
| CAR22-63 | 138 | EVQLQQSGPGLVKPSQTLSLTCAISGDSVLSNSDTWNWIRQSPSRGLEWLGRTYHRSTWYDDYASS VRGRVSINVDTSKNQYSLQLNAVTPEDTGVYYCARDRLQDGNSWSDAFDVWGQGTMVTVSSGGGGS GGGGSGGGGSQSALTQPASVSGSPGQSITISCTGTSSDVGGYNYVSWYQQHPGKAPKLMIYEVSNR PSGVSNRFSGSKSGNTASLTISGLQAEDEADYYCSSYTSSSTLYIFGTGTKVTVLG |
| CAR22-64 | 139 | EVQLQQSGPGLVKPSQTLPLTCAISGDSVLSNSDTWNWIRQSPSRGLEWLGRTYHRSTWYDDYASS VRGRVSINVDTSKNQYSLQLNAVTPEDTGVYYCARVRLQDGNSWSDAFDVWGQGTMVTVSSGGGGS GGGGSGGGGPQSALTQPASASGSPGQSVTISCTGTSSDVGGYNYVSWYQQHPGKAPKLMIYDVSNR PSGVSNRFSGSKSGNTASLTISGLQAEDEADYYCSSYTSSSTLYVFGTGTQLTVL |
| CAR22-65 | 140 | EVQLQQSGPGLVKPSQTLSLTCAISGDSMLSNSDTWNWIRQSPSRGLEWLGRTYHRSTWYDDYASS VRGRVSINVDTSKNQYSLQLNAVTPEDTGVYYCARVRLQDGNSWSDAFDVWGQGTMVTVSSGGGGS GGGGSGGGGSQSALTQPASASGSPGQSVTISCTGTSSDVGGYNYVSWYQQHPGKAPKLMIYDVSNR PSGVSNRFSGSKSGNTASLTISGLQAEDEADYYCSSYTSSSTLYVFGTGTQLTVL |

In some embodiments, the antigen binding domain comprises a HC CDR1, a HC CDR2, and a HC CDR3 of any heavy chain binding domain amino acid sequences listed in Table 6A or 6B. In embodiments, the antigen binding domain further comprises a LC CDR1, a LC CDR2, and a LC CDR3. In embodiments, the antigen binding domain comprises a LC CDR1, a LC CDR2, and a LC CDR3 of any light chain binding domain amino acid sequences listed in Table 6A or 6B.

In some embodiments, the antigen binding domain comprises one, two or all of LC CDR1, LC CDR2, and LC CDR3 of any light chain binding domain amino acid sequences listed in Table 6A or 6B, and one, two or all of HC CDR1, HC CDR2, and HC CDR3 of any heavy chain binding domain amino acid sequences listed in Table 6A or 6B.

In some embodiments, the CDRs are defined according to the Kabat numbering scheme, the Chothia numbering scheme, or a combination thereof.

CD22-64 and CD22-65 were based on affinity maturation of clone CD22-12. All three constructs were tested and found to have activity (see Example 25 herein). Based on these observations, a structural genus was designed to encompass the working examples. Thus, in some embodiments, a CD22 binding domain described herein comprises a HCDR3 having a sequence: XRLQDGNSWSDAFDV (SEQ ID NO: 141). In some embodiments, X is any amino acid, any canonical amino acid, a nonpolar amino acid (e.g., G, A, V, L, I, P, M, F, or W), a nonpolar amino acid without an aromatic ring (e.g., G, A, V, L, I, P, or M), or an acidic amino acid (e.g., D or E).

Furthermore, CAR22-53 and CAR22-57 through CAR22-65 have structural similarities in their CDRs. A structural genus was designed to encompass these working examples. Thus, in some embodiments, a CD22 binding domain described herein comprises a LCDR1 having a sequence: TGX$_1$X$_2$X$_3$DX$_4$GX$_5$X$_6$X$_7$X$_8$VS (SEQ ID NO: 1334). In some embodiments, X$_1$, X$_2$, X$_3$, X$_4$, X$_5$, X$_6$, X$_7$, or X$_8$, or any combination thereof, is each independently any amino acid, e.g., any canonical amino acid. In some embodiments, X$_4$ or X$_5$ or both are each independently nonpolar amino acid (e.g., G, A, V, L, I, P, M, F, or W) or a nonpolar amino acid without an aromatic ring (e.g., G, A, V, L, I, P, or M). In some embodiments, X$_6$ is an aromatic amino acid (e.g., F, Y, or W). In some embodiments, X$_1$ is S or T; X$_2$ is R or S; X$_3$ is N or S, X$_4$ is V or I, X$_5$ is A or G; X$_6$ is Y or F; X$_7$ is E or N; or X$_8$ is S or Y, or any combination thereof. In some embodiments, X$_1$ is S or T; X$_2$ is R or S; X$_3$ is N or S, X$_4$ is V or I, X$_5$ is A or G; X$_6$ is Y or F; X$_7$ is E or N; and X$_8$ is S or Y.

Similarly, in some embodiments, a CD22 binding domain described herein comprises a LCDR2 having a sequence: X$_1$VX$_2$NRPS (SEQ ID NO: 1335). In some embodiments, X$_1$ or X$_2$ or both is each independently any amino acid, e.g., any canonical amino acid. In some embodiments, X$_1$ is an acidic amino acid (e.g., D or E), a nonpolar amino acid (e.g., G, A, V, L, I, P, M, F, or W), or a nonpolar amino acid without an aromatic ring (e.g., G, A, V, L, I, P, or M). In embodiments, X$_2$ is a nonpolar amino acid (e.g., G, A, V, L, I, P, M, F, or W), a nonpolar amino acid without an aromatic ring (e.g., G, A, V, L, I, P, or M), or a polar uncharged amino acid (e.g., S, T, N, or Q). In some embodiments, X$_1$ is E, G, or D and/or X$_2$ is N, I, S, or T.

Similarly, in some embodiments, a CD22 binding domain described herein comprises a LCDR3 having a sequence: SSX$_1$X$_2$X$_3$X$_4$X$_5$X$_6$X$_7$X$_8$X$_9$ (SEQ ID NO: 1336). In some embodiments, X$_1$, X$_2$, X$_3$, X$_4$, X$_5$, X$_6$, X$_7$, or X$_8$, or any combination thereof, is each independently any amino acid, e.g., any canonical amino acid. In some embodiments, X$_1$ is an aromatic amino acid (e.g., F, Y, or W) or a positively charged amino acid (e.g., K, R, or H). In some embodiments, X$_2$ is a nonpolar amino acid (e.g., G, A, V, L, I, P, M, F, or W), a nonpolar amino acid without an aromatic ring (e.g., G, A, V, L, I, P, or M), or a polar uncharged amino acid (e.g., S, T, N, or Q). In some embodiments, X$_3$ is a polar uncharged amino acid (e.g., S, T, N, or Q). In some embodiments, X$_4$ is a nonpolar amino acid (e.g., G, A, V, L, I, P, M, F, or W), a nonpolar amino acid without an aromatic ring (e.g., G, A, V, L, I, P, or M), or a polar uncharged amino acid (e.g., S, T, N, or Q). In some embodiments, X$_5$ is a positively charged amino acid (e.g., K, R, or H) or a polar uncharged amino acid (e.g., S, T, N, or Q). In some embodiments, X$_6$ is a polar uncharged amino acid (e.g., S, T, N, or Q), a nonpolar amino acid (e.g., G, A, V, L, I, P, M, F, or W), a nonpolar amino acid without an aromatic ring (e.g., G, A, V, L, I, P, or M). In some embodiments, X$_7$ is a nonpolar amino acid (e.g., G, A, V, L, I, P, M, F, or W), a nonpolar amino acid without an aromatic ring (e.g., G, A, V, L, I, P, or M) or an aromatic amino acid (e.g., F, Y, or W). In some embodiments, $X_8$ is absent or an aromatic amino acid (e.g., F, Y, or W). In some embodiments, $X_9$ is a nonpolar amino acid (e.g., G, A, V, L, I, P, M, F, or W), a nonpolar amino acid without an aromatic ring (e.g., G, A, V, L, I, P, or M). In some embodiments, $X_1$ is Y or H, $X_2$ is A or T, $X_3$ is S or T; $X_4$ is G, T, or S, $X_5$ is R or S, $X_6$ is T or P, $X_7$ is L or Y, $X_8$ is Y or absent, or $X_9$ is V or I, or any combination thereof.

In some embodiments, $X_1$ is Y or H, X2 is A or T, $X_3$ is S or T; $X_4$ is G, T, or S, $X_5$ is R or S, $X_6$ is T or P, $X_7$ is L or Y, $X_8$ is Y or absent, and $X_9$ is V or I. The sequences of human CDR sequences of the scFv domains are shown in Table 7A, 7B, or 7C for the heavy chain variable domains and in Table 8A or 8B for the light chain variable domains. "ID" stands for the respective SEQ ID NO for each CDR.

TABLE 7A

Heavy Chain Variable Domain CDRs of CD22 CARs. CDRs are identified according to the "combined" definition.

| Candidate | HCDR1 | SEQ ID NO: | HCDR2 | SEQ ID NO: | HCDR3 | SEQ ID NO: |
|---|---|---|---|---|---|---|
| m971 | GDSVSSNSAAWN | 142 | RTYYRSKWYNDYAVSVKS | 181 | EVTGDLEDAFDI | 449 |
| CAR22-1 | GFTVSSNYMS | 143 | VIYSGGSTYYADSVKG | 182 | QSTPYDSSGYYSGDAFDI | 450 |
| CAR22-2 | GDSVSSNSAAWN | 144 | RTYYRSKWYNDYAVSVKS | 183 | DLGWIAVAGTFDY | 451 |
| CAR22-3 | GDSVLSNSDTWN | 145 | RTYHRSTWYDDYASSVRG | 184 | DRLQDGNSWSDAFDV | 452 |
| CAR22-4 | GFTFDDYAMH | 146 | GISWNSGSIGYADSVKG | 185 | GLSSWHFHDALDI | 453 |
| CAR22-5 | GFTFDDYAMH | 147 | GISWNSGSIGYADSVKG | 186 | DKGGGYYDFWSGSDY | 454 |
| CAR22-6 | GDSVSSNSATWT | 148 | RTYYRSTWYNDYAVSVKS | 187 | EGSGSYYAY | 455 |
| CAR22-7 | GYTFTGYYMH | 149 | WINPNSGGTNYAQKFQG | 188 | DYWGYYGSGTLDY | 456 |
| CAR22-8 | GYTFTSYGIS | 150 | WISAYNGNTNYAQKLQG | 189 | AGLALYSNYVPYYYYGMDV | 457 |
| CAR22-9 | GFTFSNAWMN | 151 | RIKSKTDGGTADYAAPVKG | 190 | GATDV | 458 |
| CAR22-10 | GDSVLSNSDTWN | 152 | RTYHRSTWYDDYASSVRG | 191 | DRLQDGNSWSDAFDV | 459 |
| CAR22-11 | GDSVSSNSAAWN | 153 | RTYYRSKWYNDYAVSVKS | 192 | EESSSGWYEGNWFDP | 460 |
| CAR22-12 | GDSVLSNSDTWN | 154 | RTYHRSTWYDDYASSVRG | 193 | DRLQDGNSWSDAFDV | 461 |
| CAR22-13 | GGSISSSSYYWG | 155 | SIYYSGSTYYNPSLKS | 194 | GRMDTAMAQI | 462 |
| CAR22-14 | GYTFTSYYMH | 156 | IINPSGGSTSYAQKFQG | 195 | DLDVSLDI | 463 |
| CAR22-15 | GFTFSSYAMH | 157 | AISSNGGSTYYANSVKD | 196 | VHSSGYYHPGPNDY | 464 |
| CAR22-16 | GYTFTSYYMH | 158 | IINPSGGSTSYAQKFQG | 197 | EAGVVAVDY | 465 |
| CAR22-17 | GFTFSSYAMS | 159 | AISGSGGSTYYADSVKG | 198 | EPLFGVVEEDVDY | 466 |
| CAR22-18 | GYTFTSYYMH | 160 | IINPSGGSTSYAQKFQG | 199 | GSGSLGDAFDI | 467 |
| CAR22-19 | GYTFTSYYMH | 161 | IINPSGGSTSYAQKFQG | 429 | DGFGELSGAFDI | 468 |
| CAR22-20 | GYTFTSYYMH | 162 | IINPSGGSTSYAQKFQG | 430 | GPIGCSGGSCLDY | 469 |
| CAR22-21 | GYTFTSYYMH | 163 | IINPSGGSTSYAQKFQG | 431 | GSYGDYGDAFDI | 470 |
| CAR22-22 | GGTFSSYAIS | 164 | GIIPIFGTANYAQKFQG | 432 | DHKVVRFGY | 471 |
| CAR22-23 | GYTFTSYYMH | 165 | IINPSGGSTSYAQKFQG | 433 | GDYYMDV | 472 |
| CAR22-24 | GFTFSSYAMS | 166 | YISSSSTIYYADSVKG | 434 | DGPIRYFDHSKAFDI | 473 |
| CAR22-25 | GYTFTSYYMH | 167 | IINPSGGSTSYAQKFQG | 435 | EMDDSSGPDY | 474 |
| CAR22-26 | GYSFTGSWIG | 168 | IIYPGDSDTRYSPSFQG | 436 | GFLRGGDCCGALDI | 475 |
| CAR22-27 | GGSINSYYWS | 169 | FTSHSGNVKYNPSLTG | 437 | GLDPLFAYDAFEI | 476 |
| CAR22-28 | GFTFSDYYMS | 170 | YISSSGSTIYYADSVKG | 438 | DDFWSGSVDY | 477 |
| CAR22-29 | GYTFTSYYMH | 171 | IINPSGGSTSYAQKFQG | 439 | EDDSSGYTSPFDY | 478 |
| CAR22-30 | GYTFTGYYMH | 172 | WINPNSGGTNYAQKFQG | 440 | EPASSSWYGYYYYMDV | 479 |

TABLE 7A-continued

Heavy Chain Variable Domain CDRs of CD22 CARs. CDRs are identified according to the "combined" definition.

| Candidate | HCDR1 | SEQ ID NO: | HCDR2 | SEQ ID NO: | HCDR3 | SEQ ID NO: |
|---|---|---|---|---|---|---|
| CAR22-31 | GYTFTSYDIN | 173 | WMNPNSGNTGYAQKFQG | 441 | GDSNYWSYYGMDV | 480 |
| CAR22-32 | GYTFTSYGIS | 174 | WISAYNGNTNYAQKLQG | 442 | FSSSDSYDY | 481 |
| CAR22-33 | GFSLNTFGMSVS | 175 | LIDWDDDKYYSTSLRT | 443 | IYGGDRTNTQAPYFFDL | 482 |
| CAR22-34 | GASITSRHWWN | 176 | QIYHSGTTTYNPSLGS | 444 | DYLELATYYGMDV | 483 |
| CAR22-35 | GYTFTSYYMH | 177 | IINPSGGSTSYAQKFQG | 445 | DLAAAGNYYYYGMDV | 484 |
| CAR22-36 | GYTFTSYYMH | 178 | IINPSGGSTSYAQKFQG | 446 | DDDFWSGSGAFDI | 485 |
| CAR22-37 | GYTFTSYYMH | 179 | IINPSGGSTSYAQKFQG | 447 | PEGVSYYDSSVLDY | 486 |
| CAR22-38 | GYTFTSYYMH | 180 | IINPSGGSTSYAQKFQG | 448 | GGYGDYLDAFDI | 487 |

TABLE 7B

Heavy Chain Variable Domain CDRs of CD22 CARs

| Candidate | HCDR1 | SEQ ID NO: | HCDR2 | SEQ ID NO: | HCDR3 | SEQ ID NO: |
|---|---|---|---|---|---|---|
| CAR22-53 Kabat | SNSAAWN | 488 | RTYYRSKWYSDYAVSVKS | 499 | DPYDFWSGYPDAFDI | 510 |
| CAR22-53 Chothia | GDSVSSNSA | 489 | YYRSKWY | 500 | DPYDFWSGYPDAFDI | 511 |
| CAR22-53 Combined Kabat/Chothia | GDSVSSNSAAWN | 1111 | RTYYRSKWYSDYAVSVKS | 1113 | DPYDFWSGYPDAFDI | 1115 |
| CAR22-53 IMGT | GDSVSSNSAA | 1112 | TYYRSKWYS | 1114 | ARDPYDFWSGYPDAFDI | 1116 |
| CAR22-57 Combined | GDSVSNNNAAWN | 490 | RTYHRSTWYNDYVGSVKS | 501 | ETDYGDYGAFDI | 512 |
| CAR22-57 Kabat | NNNAAWN | 1337 | RTYHRSTWYNDYVGSVKS | 1346 | ETDYGDYGAFDI | 1355 |
| CAR22-58 Combined | GDSVSSNSAAWN | 491 | RTFYRSKWYNDYAVSVKG | 502 | GDYYYGLDV | 513 |
| CAR22-58 Kabat | SNSAAWN | 1338 | RTFYRSKWYNDYAVSVKG | 1347 | GDYYYGLDV | 1356 |
| CAR22-59 Combined | GDSVLSNSDTWN | 492 | RTYHRSTWYDDYASSVRG | 503 | DRLQDGNSWSDAFDV | 514 |
| CAR22-59 Kabat | SNSDTWN | 1339 | RTYHRSTWYDDYASSVRG | 1348 | DRLQDGNSWSDAFDV | 1357 |
| CAR22-60 Combined | GDSVLSNSDTWN | 493 | RTYHRSTWYDDYASSVRG | 504 | DRLQDGNSWSDAFDV | 515 |
| CAR22-60 Kabat | SNSDTWN | 1340 | RTYHRSTWYDDYASSVRG | 1349 | DRLQDGNSWSDAFDV | 1358 |
| CAR22-61 Combined | GDSVLSNSDTWN | 494 | RTYHRSTWYDDYASSVRG | 505 | DRLQDGNSWSDAFDV | 516 |
| CAR22-61 Kabat | SNSDTWN | 1341 | RTYHRSTWYDDYASSVRG | 1350 | DRLQDGNSWSDAFDV | 1359 |
| CAR22-62 Combined | GDSVLSNSDTWN | 495 | RTYHRSTWYDDYASSVRG | 506 | DRLQDGNSWSDAFDV | 517 |

TABLE 7B-continued

Heavy Chain Variable Domain CDRs of CD22 CARs

| Candidate | HCDR1 | SEQ ID NO: | HCDR2 | SEQ ID NO: | HCDR3 | SEQ ID NO: |
|---|---|---|---|---|---|---|
| CAR22-62 Kabat | SNSDTWN | 1342 | RTYHRSTWYDDYASSVRG | 1351 | DRLQDGNSWSDAFDV | 1360 |
| CAR22-63 Combined | GDSVLSNSDTWN | 496 | RTYHRSTWYDDYASSVRG | 507 | DRLQDGNSWSDAFDV | 518 |
| CAR22-63 Kabat | SNSDTWN | 1343 | RTYHRSTWYDDYASSVRG | 1352 | DRLQDGNSWSDAFDV | 1361 |
| CAR22-64 Combined | GDSVLSNSDTWN | 497 | RTYHRSTWYDDYASSVRG | 508 | VRLQDGNSWSDAFDV | 519 |
| CAR22-64 Kabat | SNSDTWN | 1344 | RTYHRSTWYDDYASSVRG | 1353 | VRLQDGNSWSDAFDV | 1362 |
| CAR22-65 Combined | GDSMLSNSDTWN | 498 | RTYHRSTWYDDYASSVRG | 509 | VRLQDGNSWSDAFDV | 520 |
| CAR22-65 Kabat | SNSDTWN | 1345 | RTYHRSTWYDDYASSVRG | 1354 | VRLQDGNSWSDAFDV | 1363 |

TABLE 7C

Heavy Chain Variable Domain CDRs of CD22 CARs. CDRs are identified according to Kabat.

| Candidate | HCDR1 | SEQ ID NO: | HCDR2 | SEQ ID NO: | HCDR3 | SEQ ID NO: |
|---|---|---|---|---|---|---|
| m971 | SNSAAWN | 1364 | RTYYRSKWYNDYAVSVKS | 1403 | EVTGDLEDAFDI | 1442 |
| CAR22-1 | SNYMS | 1365 | VIYSGGSTYYADSVKG | 1404 | QSTPYDSSGYYSGDAFDI | 1443 |
| CAR22-2 | SNSAAWN | 1366 | RTYYRSKWYNDYAVSVKS | 1405 | DLGWIAVAGTFDY | 1444 |
| CAR22-3 | SNSDTWN | 1367 | RTYHRSTWYDDYASSVRG | 1406 | DRLQDGNSWSDAFDV | 1445 |
| CAR22-4 | DYAMH | 1368 | GISWNSGSIGYADSVKG | 1407 | GLSSWHFHDALDI | 1446 |
| CAR22-5 | DYAMH | 1369 | GISWNSGSIGYADSVKG | 1408 | DKGGGYYDFWSGSDY | 1447 |
| CAR22-6 | SNSATWT | 1370 | RTYYRSTWYNDYAVSVKS | 1409 | EGSGSYYAY | 1448 |
| CAR22-7 | GYYMH | 1371 | WINPNSGGTNYAQKFQG | 1410 | DYWGYYGSGTLDY | 1449 |
| CAR22-8 | SYGIS | 1372 | WISAYNGNTNYAQKLQG | 1411 | AGLALYSNYVPYYYYGMDV | 1450 |
| CAR22-9 | NAWMN | 1373 | RIKSKTDGGTADYAAPVKG | 1412 | GATDV | 1451 |
| CAR22-10 | SNSDTWN | 1374 | RTYHRSTWYDDYASSVRG | 1413 | DRLQDGNSWSDAFDV | 1452 |
| CAR22-11 | SNSAAWN | 1375 | RTYYRSKWYNDYAVSVKS | 1414 | EESSSGWYEGNWFDP | 1453 |
| CAR22-12 | SNSDTWN | 1376 | RTYHRSTWYDDYASSVRG | 1415 | DRLQDGNSWSDAFDV | 1454 |
| CAR22-13 | SSSYYWG | 1377 | SIYYSGSTYYNPSLKS | 1416 | GRMDTAMAQI | 1455 |
| CAR22-14 | SYYMH | 1378 | IINPSGGSTSYAQKFQG | 1417 | DLDVSLDI | 1456 |
| CAR22-15 | SYAMH | 1379 | AISSNGGSTYYANSVKD | 1418 | VHSSGYYHPGPNDY | 1457 |
| CAR22-16 | SYYMH | 1380 | IINPSGGSTSYAQKFQG | 1419 | EAGVVAVDY | 1458 |
| CAR22-17 | SYAMS | 1381 | AISGSGGSTYYADSVKG | 1420 | EPLFGVVEEDVDY | 1459 |
| CAR22-18 | SYYMH | 1382 | IINPSGGSTSYAQKFQG | 1421 | GSGSLGDAFDI | 1460 |
| CAR22-19 | SYYMH | 1383 | IINPSGGSTSYAQKFQG | 1422 | DGFGELSGAFDI | 1461 |
| CAR22-20 | SYYMH | 1384 | IINPSGGSTSYAQKFQG | 1423 | GPIGCSGGSCLDY | 1462 |

TABLE 7C-continued

Heavy Chain Variable Domain CDRs of CD22 CARs. CDRs are identified according to Kabat.

| Candidate | HCDR1 | SEQ ID NO: | HCDR2 | SEQ ID NO: | HCDR3 | SEQ ID NO: |
|---|---|---|---|---|---|---|
| CAR22-21 | SYYMH | 1385 | IINPSGGSTSYAQKFQG | 1424 | GSYGDYGDAFDI | 1463 |
| CAR22-22 | SYAIS | 1386 | GIIPIFGTANYAQKFQG | 1425 | DHKVVRFGY | 1464 |
| CAR22-23 | SYYMH | 1387 | IINPSGGSTSYAQKFQG | 1426 | GDYYMDV | 1465 |
| CAR22-24 | SYAMS | 1388 | YISSSSSTIYYADSVKG | 1427 | DGPIRYFDHSKAFDI | 1466 |
| CAR22-25 | SYYMH | 1389 | IINPSGGSTSYAQKFQG | 1428 | EMDDSSGPDY | 1467 |
| CAR22-26 | GSWIG | 1390 | IIYPGDSDTRYSPSFQG | 1429 | GFLRGGDCCGALDI | 1468 |
| CAR22-27 | SYYWS | 1391 | FTSHSGNVKYNPSLTG | 1430 | GLDPLFAYDAFEI | 1469 |
| CAR22-28 | DYYMS | 1392 | YISSSGSTIYYADSVKG | 1431 | DDFWSGSVDY | 1470 |
| CAR22-29 | SYYMH | 1393 | IINPSGGSTSYAQKFQG | 1432 | EDDSSGYTSPFDY | 1471 |
| CAR22-30 | GYYMH | 1394 | WINPNSGGTNYAQKFQG | 1433 | EPASSSWYGYYYYMDV | 1472 |
| CAR22-31 | SYDIN | 1395 | WMNPNSGNTGYAQKFQG | 1434 | GDSNYWSYYGMDV | 1473 |
| CAR22-32 | SYGIS | 1396 | WISAYNGNTNYAQKLQG | 1435 | FSSSDSYDY | 1474 |
| CAR22-33 | TFGMSVS | 1397 | LIDWDDDKYYSTSLRT | 1436 | IYGGDRTNTQAPYFFDL | 1475 |
| CAR22-34 | TSRHWWN | 1398 | QIYHSGTTTYNPSLGS | 1437 | DYLELATYYGMDV | 1476 |
| CAR22-35 | SYYMH | 1399 | IINPSGGSTSYAQKFQG | 1438 | DLAAAGNYYYYGMDV | 1477 |
| CAR22-36 | SYYMH | 1400 | IINPSGGSTSYAQKFQG | 1439 | DDDFWSGSGAFDI | 1478 |
| CAR22-37 | SYYMH | 1401 | IINPSGGSTSYAQKFQG | 1440 | PEGVSYYDSSVLDY | 1479 |
| CAR22-38 | SYYMH | 1402 | IINPSGGSTSYAQKFQG | 1441 | GGYGDYLDAFDI | 1480 |

TABLE 8A

Light Chain Variable Domain CDRs of CD22 CARs. The LC CDR sequences in this table have the same sequence under the Kabat or combined definitions.

| Candidate | LCDR1 | SEQ ID NO: | LCDR2 | SEQ ID NO: | LCDR3 | SEQ ID NO: |
|---|---|---|---|---|---|---|
| m971 | RASQTIWSYLN | 521 | AASSLQS | 560 | QQSYSIPQT | 599 |
| CAR22-1 | SGSSSNIGSNYVY | 522 | RNNQRPS | 561 | AAWDDSLSGYV | 600 |
| CAR22-2 | TGTSSDVGGYNYVS | 523 | DVSKRPS | 562 | SSYTSSSLNHV | 601 |
| CAR22-3 | TGTSSDVGGYNYVS | 524 | DVSNRPS | 563 | SSYTSSSTPYV | 602 |
| CAR22-4 | QGDSLRSYYAS | 525 | GKNNRPS | 564 | NSRDSSGNHLWV | 603 |
| CAR22-5 | QGDSLRSYYAS | 526 | GKNNRPS | 565 | NSRDSSGWV | 604 |
| CAR22-6 | TGTSSDVGGYNYVS | 527 | DVSNRPS | 566 | SSYTSSSTLYV | 605 |
| CAR22-7 | TGTSSDVGGYNYVS | 528 | DVSSRPS | 567 | SSYAGSNTLV | 606 |
| CAR22-8 | TRSSGSIASNYVQ | 529 | EDNQRPS | 568 | QSYDSSNPWV | 607 |
| CAR22-9 | SGSSSNIGSNYVY | 530 | RNNQRPS | 569 | AAWDDSLSGPV | 608 |
| CAR22-10 | TGTSSDVGGYNYVS | 531 | DVSNRPS | 570 | SSYTSSSTLVYV | 609 |
| CAR22-11 | QGDSLRSYYAS | 532 | GKNHRPS | 571 | HSRDSSGNHL | 610 |

TABLE 8A-continued

Light Chain Variable Domain CDRs of CD22 CARs. The LC CDR sequences in this table have the same sequence under the Kabat or combined definitions.

| Candidate | LCDR1 | SEQ ID NO: | LCDR2 | SEQ ID NO: | LCDR3 | SEQ ID NO: |
|---|---|---|---|---|---|---|
| CAR22-12 | TGTSSDVGGYNYVS | 533 | DVSNRPS | 572 | SSYTSSSTLYV | 611 |
| CAR22-13 | TGSSGSFASSYVQ | 534 | EDNQRPS | 573 | QSYDGATWV | 612 |
| CAR22-14 | SGTSSDVGGYNSVS | 535 | DVNNRPS | 574 | SSYTSSSTLF | 613 |
| CAR22-15 | QGDSLRTYYAT | 536 | DENNRPS | 575 | SSRDSSGNPSCV | 614 |
| CAR22-16 | TGTSSDVGGYNYVS | 537 | DVSNRPS | 576 | SSYTSSSTWV | 615 |
| CAR22-17 | RSSQSLLAGNGHNYLD | 538 | LGSNRAS | 577 | MQALQNPLT | 616 |
| CAR22-18 | TGSSSDVGGYNYVS | 539 | EVSNRPS | 578 | SSYTSSSTLV | 617 |
| CAR22-19 | TGTSSDVGGYNYVS | 540 | DVSNRPS | 579 | SSYASSSTLV | 618 |
| CAR22-20 | TGTNSDVGRYNYVS | 541 | EVSYRPS | 580 | SSYTTSSTLD | 619 |
| CAR22-21 | TGTSSDVGGYKYVS | 542 | DVSNRPS | 581 | SSYTSSSTLV | 620 |
| CAR22-22 | TLSSGHSSYAIA | 543 | VNSDGSLSKGD | 582 | QTWGSGMAI | 621 |
| CAR22-23 | TGTSSDVGGYNYVS | 544 | EVSKRPS | 583 | SSYTSSGTLV | 622 |
| CAR22-24 | QGDSLRSYYAS | 545 | GKNNRPS | 584 | NSRDSSGNPYV | 623 |
| CAR22-25 | TGTSSDVGGYNYVS | 546 | EVSNRPS | 585 | SSYTSSSTLV | 624 |
| CAR22-26 | RSSQSLLHSNGYNYLD | 547 | LGSNRAS | 586 | MQALQTPPWT | 625 |
| CAR22-27 | RSSQSLLHSNGYNYLD | 548 | LGSNRAS | 587 | MQVLQTPPLT | 626 |
| CAR22-28 | GGTNIGSKNVH | 549 | YDSDRPS | 588 | QVWDSSSDHWV | 627 |
| CAR22-29 | GGHNIRSKNVH | 550 | YDGDRPS | 589 | QVWDSDSDHYV | 628 |
| CAR22-30 | RASQSINTYLN | 551 | AASNLQS | 590 | QQSYSSLLT | 629 |
| CAR22-31 | TGTSSDVGGYNYVS | 552 | DADKRPS | 591 | CSYAGGSTWV | 630 |
| CAR22-32 | RASQSVTSNLA | 553 | AASTRAT | 592 | QQYHTWPPLT | 631 |
| CAR22-33 | RSSQSLLHSNGYNYLD | 554 | LGSNRAS | 593 | MQALQTPWT | 632 |
| CAR22-34 | RSSQSLLYSDGYNYLD | 555 | LGSNRAS | 594 | MQALQTQS | 633 |
| CAR22-35 | QGDSLRSYFTS | 556 | GNNNRPS | 595 | DSRDSSGDHLV | 634 |
| CAR22-36 | QGDSLRSYYAS | 557 | GKNNRPS | 596 | NSRDSSGNHPVV | 635 |
| CAR22-37 | TGTSSDVGGYKHVS | 558 | DVSNRPS | 597 | VSYRNFNSLV | 636 |
| CAR22-38 | TGTSSDVGGYNYVS | 559 | EVSNRPS | 598 | SSYTSSSTLV | 637 |

TABLE 8B

Light Chain Variable Domain CDRs of CD22 CARs. The LC CDR sequences in this table have the same sequence under the Kabat or combined definitions.

| Candidate | LCDR1 | SEQ ID NO: | LCDR2 | SEQ ID NO: | LCDR3 | SEQ ID NO: |
|---|---|---|---|---|---|---|
| CAR22-53 Kabat | TGTSSDVGGYNYVS | 638 | EVNNRPS | 649 | SSYTSGRTLYV | 660 |

TABLE 8B-continued

Light Chain Variable Domain CDRs of CD22 CARs.
The LC CDR sequences in this table have the same sequence under the Kabat or combined definitions.

| Candidate | LCDR1 | SEQ ID NO: | LCDR2 | SEQ ID NO: | LCDR3 | SEQ ID NO: |
|---|---|---|---|---|---|---|
| CAR22-53 Chothia | TSSDVGGYNY | 639 | EVN | 650 | YTSGRTLY | 661 |
| CAR22-53 Combined | TGTSSDVGGYNYVS | 1117 | EVNNRPS | 1119 | SSYTSGRTLYV | 1121 |
| CAR22-53 IMGT | SSDVGGYNY | 1118 | EVN | 1120 | SSYTSGRTLYV | 1122 |
| CAR22-57 Combined | TGSRNDIGAYESVS | 640 | GVNNRPS | 651 | SSHTTTSTLYV | 662 |
| CAR22-58 Combined | TGSSSDVGGYNSVS | 641 | EVINRPS | 652 | SSYTSSSTYV | 663 |
| CAR22-59 Combined | TGSSSDIGGFNYVS | 642 | EVTNRPS | 653 | SSYASGSPLYV | 664 |
| CAR22-60 Combined | TGTSSDIGGYNYVS | 643 | EVSNRPS | 654 | SSYTSSSTLYV | 665 |
| CAR22-61 Combined | TGTSSDVGGYNYVS | 644 | EVSNRPS | 655 | SSYTSSSTLYV | 666 |
| CAR22-62 Combined | TGTSSDVGGYNYVS | 645 | DVSNRPS | 656 | SSYTSSSTLYV | 667 |
| CAR22-63 Combined | TGTSSDVGGYNYVS | 646 | EVSNRPS | 657 | SSYTSSSTLYI | 668 |
| CAR22-64 Combined | TGTSSDVGGYNYVS | 647 | DVSNRPS | 658 | SSYTSSSTLYV | 669 |
| CAR22-65 Combined | TGTSSDVGGYNYVS | 648 | DVSNRPS | 659 | SSYTSSSTLYV | 670 |

TABLE 9A

Heavy Chain Variable Regions of CD22 antibody molecules

| Candidate ID | | Heavy Chain Variable region |
|---|---|---|
| m971 | 700 | QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTV |
| CAR22-1 | 701 | QVQLVQSGGGLIQPGGSLRLSCAASGFTVSSNYMSWVRQAPGKGLEWVSVIYSGGSTYYADSVKGRFTISRDNSKNTLYLQMNSLRAEDTAVYYCASQSTPYDSSGYYSGDAFDIWGQGTMVTV |
| CAR22-2 | 702 | EVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARDLGWIAVAGTFDYWGQGTLVTV |
| CAR22-3 | 703 | EVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGAYYCARDRLQDGNSWSDAFDVWGQGTMVTV |
| CAR22-4 | 704 | EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKGLSSWHFHDALDIWGQGTMVTV |
| CAR22-5 | 705 | EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDKGGGYYDFWSGSDYWGQGTLVTV |
| CAR22-6 | 706 | EVQLQQSGPGLVKPSLTLSLTCAISGDSVSSNSATWTWIRQSPSRGLEWLGRTYYRSTWYNDYAVSVKSRITINPDTSKNQFSLQLNSVTPEDTAVYYCAREGSGSYYAYWGQGTLVTV |

TABLE 9A-continued

Heavy Chain Variable Regions of CD22 antibody molecules

| Candidate | ID | Heavy Chain Variable region |
|---|---|---|
| CAR22-7 | 707 | QVQLVQSGAEVKKPGASVKVSCKASGYTFTGYYMHWVRQAPGQGLEWMGWINP-NSGGTNYAQKFQGRVTMTRDTSISTAYMELSRLRSDDTAVYYCARDYWGYYGSGTLDYWGQGTLVTV |
| CAR22-8 | 708 | QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARAGLALYSNYVPYYYYGMDVWGQGTTVTV |
| CAR22-9 | 709 | EVQLVESGGGLVKPGGSLRLSCVASGFTFSNAWMNWVRQAPGKGLEWVGRIKSKTDGGTADYAAPVKGRFTISRDDSKNTMYLQMNSLKTEDTGVYYCITGATDVWGQGTTVTV |
| CAR22-10 | 710 | EVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTV |
| CAR22-11 | 711 | EVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREESSSGWYEGNWFDPWGQGTLVTV |
| CAR22-12 | 712 | EVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTV |
| CAR22-13 | 713 | QVQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARGRMDTAMAQIWGQGTMVTV |
| CAR22-14 | 714 | QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDLDVSLDIWGQGTMVTV |
| CAR22-15 | 715 | EVQLVESGGGLVQPGGSLRLSCAASGFTFSSYAMHWVRQAPGKGLEYVSAISSNGGSTYYANSVKDRFTISRDNSKNTLYLQMGSLRAEDMAVYYCARVHSSGYYHPGPNDYWGQGTLVTV |
| CAR22-16 | 716 | EVQLVESGAEVKKPGASVKVSCKASGYTFTSYYMHWVRQAPGQGLEWMGIINPSGGSTSYAQKFQGRVTMTRDTSTSTAYMELSSLRSEDTAVYYCAREAGVVAVDYWGQGTLVTV |
| CAR22-17 | 717 | QVQLVQSGGGVVQPGRSLRLSCAASGFTFSSYAMSWVRQAPGKGLEWVSAISGSGGSTYYADSVKGRFTISRDNSKNTLYLQMNSLRAEDTAVYYCAKEPLFGVVEEDVDYWGQGTLVTV |
| CAR22-18 | 718 | QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARGSGSLGDAFDIWGQGTMVTV |
| CAR22-19 | 719 | QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDGFGELSGAFDIWGQGTMVTV |
| CAR22-20 | 720 | EVQLVESGAEVKKPGASVKVSCKASGYTFTSYYMHWVRQAPGQGLEWMGIINPSGGSTSYAQKFQGRVTMTRDTSTSTVYMELSSLRSEDTAVYYCARGPIGCSGGSCLDYWGQGTLVTV |
| CAR22-21 | 721 | QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARGSYGDYGDAFDIWGQGTTVTV |
| CAR22-22 | 722 | EVQLVESGAEVKKPGSSVKVSCKASGGTFSSYAISWVRQAPGQGLEWMGGIIPIFGTANYAQKFQGRVTITADESTSTAYMELSSLRSEDTAVYYCARDHKVVRFGYWGQGTLVTV |
| CAR22-23 | 723 | QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARGDYYMDVWGKGTTVTV |
| CAR22-24 | 724 | EVQLVESGGGLVQPGGSLRLSCAASGFTFSSYAMSWVRQAPGKGLEWVSYISSSSSTIYYADSVKGRFTISRDNAKNSLYLQMNSLRAEDTAVYYCARDGPIRYFDHSKAFDIWGQGTMVTV |
| CAR22-25 | 725 | QVQLVQSGAEVKKPGASVKVSCKASGYTFTSYYMHWVRQAPGQGLEWMGIINPSGGSTSYAQKFQGRVTMTRDTSISTAYMELSRLRSDDTAVYYCAREMDDSSGPDYWGQGTLVTV |
| CAR22-26 | 726 | EVQLVESGAEVKKPGESLKISCKGSGYSFTGSWIGWVRQMPGKGLEWMGIIYPGDSDTRYSPSFQGQVTISADKSISTAYLQWSSLKASDTAMYYCARGFLRGGDCCGALDIWGQGTMVTV |
| CAR22-27 | 727 | QVQLQESGPGLVKPSETLSLTCSVSGGSINSYYWSWIRQAPGKGLEWIAFTSHSGNVKYNPSLTGRVTIAVDTSKNQFYLEVTSVTAADTAVYFCARGLDPLFAYDAFEIWGLGTMVTV |

TABLE 9A-continued

Heavy Chain Variable Regions of CD22 antibody molecules

| Candidate | ID | Heavy Chain Variable region |
|---|---|---|
| CAR22-28 | 728 | EVQLVESGGGLVKPGGSLRLSCAASGFTFSDYYMSWIRQAPGKGLEWVSYISSSGSTIYY ADSVKGRFTISRDNAKNSLYLQMNSLRAEDTAVYYCARDDFWSGSVDYWGQGTLVTV |
| CAR22-29 | 729 | QVQLVQSGAEVKKPGASVKVSCKASGYTFTSYYMHWVRQAPGQGLEWMGIINPSGGST SYAQKFQGRVTMTRDTSTSTVYMELSSLRSEDTAVYYCAREDDSSGYTSPFDYWGQGTL VTV |
| CAR22-30 | 730 | EVQLVESGAEVKKPGASVKVSCKASGYTFTGYYMHWVRQAPGQGLEWMGWINPNSGG TNYAQKFQGRVTMTRDTSISTAYMELSRLRSDDTAVYYCAREPASSSWYGYYYYMDVW GKGTLVTV |
| CAR22-31 | 731 | QVQLVQSGAEVKKPGASVKVSCKASGYTFTSYDINWVRQATGQGLEWMGWMNPNSGN TGYAQKFQGRVTMTRNTSISTAYMELSSLRSEDTAVYYCARG-DSNYWSYYGMDVWGQGTLVTV |
| CAR22-32 | 732 | QVQLVQSGAEVKKPGASVKVSCKASGYTFTSYGISWVRQAPGQGLEWMGWISAYNGNT NYAQKLQGRVTMTTDTSTSTAYMELRSLRSDDTAVYYCASFSSSDSYDYWGQGTLVTV |
| CAR22-33 | 733 | QVNLRESGPALVKPTQTLTLTCTFSGFSLNTFGMSVSWIRQPPGKALEWLALIDWDDDKY YSTSLRTRLTISKDTAKNQVVLRMTNMDPMDTATYYCARIYGGDRTNTQAPYFFDLWG QGTLVTV |
| CAR22-34 | 734 | QVQLQESGPGLVKPSGTLSLTCAVSGASITSRHWWNWVRHSPGKGLEWIGQIYHSGTTT YNPSLGSRVTISVDKSKNQISLELRSVTAADTATYYCVRDYLELATYYGMDVWGQGTTV TV |
| CAR22-35 | 735 | QVQLVQSGAEVKKPGASVKVSCKASGYTFTSYYMHWVRQAPGQGLEWMGIINPSGGST SYAQKFQGRVTMTRDTSTSTVYMELSSLRSEDTAVYYCARDLAAAGNYYYYGMDVWG QGTTVTV |
| CAR22-36 | 736 | QVQLVQSGAEVKKPGASVKVSCKASGYTFTSYYMHWVRQAPGQGLEWMGIINPSGGST SYAQKFQGRVTMTRDTSTSTVYMELSSLRSEDTAVYYCARDDDFWSGSGAFDIWGQGTT VTV |
| CAR22-37 | 737 | QVQLVQSGAEVKKPGASVKVSCKASGYTFTSYYMHWVRQAPGQGLEWMGIINPSGGST SYAQKFQGRVTMTRDTSTSTVYMELSSLRSEDTAVYYCARPEGVSYYDSSVLDYWGQG TLVTV |
| CAR22-38 | 738 | QVQLVQSGAEVKKPGASVKVSCKASGYTFTSYYMHWVRQAPGQGLEWMGIINPSGGST SYAQKFQGRVTMTRDTSTSTVYMELSSLRAEDTAVYYCARGGYGDYLDAFDIWGQGTT VTV |

TABLE 9B

Heavy Chain Variable Regions of CD22 antibody molecules

| Candidate | SEQ ID NO: | Heavy Chain Variable region |
|---|---|---|
| CAR22-53 | 671 | EVQLQQSGPGLVKPSQTLSLTCAISGDSVSSNSAAWNWIRQSPSRGLEWLGRTYYRSKW YSDYAVSVKSRITINPDTSKNQFSLQLNSVTPEDTAVYYCARDPYDFWSGYPDAFDIWGQ GTMVTVSS |
| CAR22-57 | 672 | EVQLQQSGPGLVKPSQTLSLTCAISGDSVSNNNAAWNWIRQSPSRGLEWLGRTYHRSTW YNDYVGSVKSRITINPDTSKNQFSLQLNSVTPEDTAVYYCARETDYGDYGAFDIWGQGTT VTVSS |
| CAR22-58 | 673 | EVQLQQSGPGLVNPSQTLSITCAISGDSVSSNSAAWNWIRQSPSRGLEWLGRTFYRSKWY NDYAVSVKGRITISPDTSKNQFSLQLNSVTPEDTAVYYCAGGDYYYGLDVWGQGTTVTV SS |
| CAR22-59 | 674 | EVQLQQSGPGLVKPSQTLSLTCAISGDSVLSNSDTWNWIRQSPSRGLEWLGRTYHRSTWY DDYASSVRGRVSINVDTSKNQYSLQLNAVTPEDTGVYYCARDRLQDGNSWSDAFDVWG QGTMVTVSS |
| CAR22-60 | 675 | EVQLQQSGPGLVKPSQTLSLTCAISGDSVLSNSDTWNWIRQSPSRGLEWLGRTYHRSTWY DDYASSVRGRVSINVDTSKNQYSLQLNAVTPEDTGVYYCARDRLQDGNSWSDAFDVWG QGTMVTVSS |
| CAR22-61 | 676 | QVQLQESGPGLVKPSQTLSLTCAISGDSVLSNSDTWNWIRQSPSRGLEWLGRTYHRSTWY DDYASSVRGRVSINVDTSKNQYSLQLNAVTPEDTGVYYCARDRLQDGNSWSDAFDVWG QGTMVTVSS |

TABLE 9B-continued

Heavy Chain Variable Regions of CD22 antibody molecules

| Candidate | SEQ ID NO: | Heavy Chain Variable region |
|---|---|---|
| CAR22-62 | 677 | EVQLQQSGPGLVKPSQTLSLTCAISGDSVLSNSDTWNWIRQSPSRGLEWLGRTYHRSTWY DDYASSVRGRVSINVDTSKNQYSLQLNAVTPEDTGVYYCARDRLQDGNSWSDAFDVWG QGTMVTVSS |
| CAR22-63 | 678 | EVQLQQSGPGLVKPSQTLSLTCAISGDSVLSNSDTWNWIRQSPSRGLEWLGRTYHRSTWY DDYASSVRGRVSINVDTSKNQYSLQLNAVTPEDTGVYYCARDRLQDGNSWSDAFDVWG QGTMVTVSS |
| CAR22-64 | 679 | EVQLQQSGPGLVKPSQTLPLTCAISGDSVLSNSDTWNWIRQSPSRGLEWLGRTYHRSTWY DDYASSVRGRVSINVDTSKNQYSLQLNAVTPEDTGVYYCARVRLQDGNSWSDAFDVWG QGTMVTVSS |
| CAR22-65 | 680 | EVQLQQSGPGLVKPSQTLSLTCAISGDSMLSNSDTWNWIRQSPSRGLEWLGRTYHRSTW YDDYASSVRGRVSINVDTSKNQYSLQLNAVTPEDTGVYYCARVRLQDGNSWSDAFDVW GQGTMVTVSS |

TABLE 10A

Light Chain Variable Regions of CD22 antibody molecules

| Candidate | ID | Light Chain Variable region |
|---|---|---|
| m971 | 739 | DIQMTQSPSSLSASVGDRVTITCRASQTIWSYLNWYQQRPGKAPNLLIYAASSLQSGVPSR FSGRGSGTDFTLTISSLQAEDFATYYCQQSYSIPQTFGQGTKLEIK |
| CAR22-1 | 740 | SYVLTQPPSASGTPGQRVTISCSGSSSNIGSNYVYWYQQLPGTAPKLLIYRNNQRPSGVPD RFSGSKSGTSASLAISGLRSEDEADYYCAAWDDSLSGYVFGTGTKLTVL |
| CAR22-2 | 741 | QSALTQPASVSGSPGQSITISCTGTSSDVGGYNYVSWYQQHPGKAPKLMIYDVSKRPSGV SNRFSGSKSGNTASLTISGLQAEDEADYYCSSYTSSSLNHVFGTGTKVTVL |
| CAR22-3 | 742 | QSALTQPASVSGSPGQSITISCTGTSSDVGGYNYVSWYQQHPGKAPKLMIYDVSNRPSGV SNRFSGSKSGNTASLTISGLQAEDEADYYCSSYTSSSTPYVFGTGTQLTVL |
| CAR22-4 | 743 | SSELTQDPAVSVALGQTVRITCQGDSLRSYYASWYQQKPGQAPVLVIYGKNNRPSGIPDR FSGSSSGNTASLTITGAQAEDEADYYCNSRDSSGNHLWVFGGGTKLTVL |
| CAR22-5 | 744 | SSELTQDPAVSVALGQTVRITCQGDSLRSYYASWYQQKPGQAPVLVIYGKNNRPSGIPDR FSGSSSGNTASLTITGAQAEDEADYYCNSRDSSGWVFGGGTKLTVL |
| CAR22-6 | 745 | QSALTQPASVSGSPGQSITISCTGTSSDVGGYNYVSWYQQHPGKAPKLMIYDVSNRPSGV SNRFSGSKSGNTASLTISGLQAEDEADYYCSSYTSSSTLYVFGTGTKVTVL |
| CAR22-7 | 746 | QSALTQPGSVSGSPGQSITISCTGTSSDVGGYNYVSWYQQHPGKAPKLIIYDVSSRPSGVS NRFSGSQSGNTASLTISGLQAEDEADYSCSSYAGSNTLVFGTGTKVTVL |
| CAR22-8 | 747 | NFMLTQPHSVSESPGKTVTISCTRSSGSIASNYVQWYQQRPGSSPTTVIYEDNQRPSGVPD RFSGSIDSSSNSASLTISGLKTEDEADYYCQSYDSSNPWVFGGGTKLTVL |
| CAR22-9 | 748 | SYVLTQPPSASGTPGQRVTISCSGSSSNIGSNYVYWYQQLPGTAPKLLIYRNNQRPSGVPD RFSGSKSGTSASLAISGLRSEDEADYYCAAWDDSLSGPVFGGGTKLTVL |
| CAR22-10 | 749 | QSALTQPASVSGSPGQSITISCTGTSSDVGGYNYVSWYQQHPGKAPKLMIYDVSNRPSGV SNRFSGSKSGNTASLTISGLQAEDEADYYCSSYTSSSTLVYVFGTGTKVTVL |
| CAR22-11 | 750 | SSELTQDPAVSVALGQTVRITCQGDSLRSYYASWYQQKPGQAPVLVIYGKNHRPSGIPDR FSGSSSGDTDSLTITGAQAEDEADYYCHSRDSSGNHLFGGGTKLTVL |
| CAR22-12 | 751 | QSALTQPASASGSPGQSVTISCTGTSSDVGGYNYVSWYQQHPGKAPKLMIYDVSNRPSGV SNRFSGSKSGNTASLTISGLQAEDEADYYCSSYTSSSTLYVFGTGTQLTVL |
| CAR22-13 | 752 | NFMLTQPHSVSESPGKTVTIPCTGSSGSFASSYVQWYQQRPGSAPATVIYEDNQRPSGVPD RFSGSVDSSSNSASLTISGLKTEDEAVYYCQSYDGATWVFGGGTKLTVL |
| CAR22-14 | 753 | QSALTQPASVSGSPGQSITISCSGTSSDVGGYNSVSWYQQYPGKAPKLMIYDVNNRPSGV SSRFSGSKSGNTASLTISGLQAEDEADYYCSSYTSSSTLFFGAGTKVTVL |
| CAR22-15 | 754 | SSELTQDPAVSVALGQTVRITCQGDSLRTYYATWYQQKPGQAPVLVFYDENNRPSGIPDR FSGSSSGNTASLTITGTQAEDEADYYCSSRDSSGNPSCVFGGGTKLTVL |

TABLE 10A-continued

Light Chain Variable Regions of CD22 antibody molecules

| Candidate ID | Light Chain Variable region |
|---|---|
| CAR22-16 | 755 QSALTQPASVSGSPGQSITISCTGTSSDVGGYNYVSWYQQHPGKAPKLMIYDVSNRPSGV SNRFSGSKSGNTASLTISGLQAEDEADYYCSSYTSSSTWVFGGGTKLTVL |
| CAR22-17 | 756 DVVMTQSPLSLPVTPGEPASISCRSSQSLLAGNGHNYLDWYLQKPGQSPQLLIYLGSNRAS GVPDRFSGSGSGTDFTLKISRVEAEDVGVYYCMQALQNPLTFGGGTKLEIKR |
| CAR22-18 | 757 QSALTQPASVSGSPGQSITISCTGSSSDVGGYNYVSWYQQHPGKAPKLMIYEVSNRPSGVS NRFSGSKSGNTASLTISGLQAEDEADYYCSSYTSSSTLVFGTGTKVTVL |
| CAR22-19 | 758 QSALTQPASVSGSPGQSITISCTGTSSDVGGYNYVSWYQQHPGKAPKLMIYDVSNRPSGV SNRFSGSKSGNTASLTISGLQAEDEADYYCSSYASSSTLVFGGGTKVTVL |
| CAR22-20 | 759 QSALTQPAYVSGSPGQSITISCTGTNSDVGRYNYVSWYQQHPGKAPKLMIYEVSYRPSGV SNRFSGSKSGNTASLTISGLQAEDEADYYCSSYTTSSTLDFGTGTKVTVL |
| CAR22-21 | 760 QSALTQPASVSGSPGQSITISCTGTSSDVGGYKYVSWYQQHPGKAPKLMIYDVSNRPSGV SNRFSGSKSGNTASLTISGLQAEDEADYYCSSYTSSSTLVFGGGTKLTVL |
| CAR22-22 | 761 HVILTQPPSASASLGASVKLTCTLSSGHSSYAIAWHQQQPEKGPRYLMKVNSDGSLSKGD GIPDRFSGSTSGAERYLTISSLQSEDEADYYCQTWGSGMAIFGGGTKLTVL |
| CAR22-23 | 762 QSALTQPASASGSPGQSVTISCTGTSSDVGGYNYVSWYQQHPGKAPKLMIYEVSKRPSGV PDRFSGSKSGNTASLTISGLQAEDEADYYCSSYTSSGTLVFGGGTKLTVL |
| CAR22-24 | 763 SSELTQDPAVSVALGQTVRITCQGDSLRSYYASWYQQKPGQAPVLVIYGKNNRPSGIPDR FSGSSSGNTASLTITGAQAEDEADYYRNSRDSSGNPYVFGTGTKVTVL |
| CAR22-25 | 764 QSALTQPASVSGSPGQSITISCTGTSSDVGGYNYVSWYQQHPGKAPKLMIYEVSNRPSGVS NRFSGSKSGNTASLTISGLQAEDEADYYCSSYTSSSTLVFGTGTKLTVL |
| CAR22-26 | 765 DIVMTQSPLSLPVTPGEPASISCRSSQSLLHSNGYNYLDWYLQKPGQSPQLLIYLGSNRAS GVPDRFSGSGSGTDFTLKISRVEAEDVGVYYCMQALQTPPWTFGQGTKLEIKR |
| CAR22-27 | 766 EIVLTQSPLSLPVTPGEPASISCRSSQSLLHSNGYNYLDWYLQKPGQSPQLLIYLGSNRASG VPDRFSGSGSGTDFTLKISRVEAEDVGVYYCMQVLQTPPLTFGGGTKVDIKR |
| CAR22-28 | 767 SYVLTQPPSVSVAPGKTATITCGGTNIGSKNVHWYQQKPGQAPVLAIYYDSDRPSGIPERF SGSNSGNTATLTISRVEAGDEADYFCQVWDSSSDH-WVFGGGTKLTVL |
| CAR22-29 | 768 SYELTQPPSVSVAPGETASIACGGHNIRSKNVHWYQQKPGQAPVLVISYDGDRPSGIPERF SGSNLGSTATLTISRVEAGDEADYYCQVWDSDSDH-YVFGTGTKVTVL |
| CAR22-30 | 769 DIQMTQSPSSLSASVGDRVTITCRASQSINTYLNWYQQKPGKPPKLLIYAASNLQSGVPSR FSGSGSGTHFTLTISSLQPDDFATYYCQQSYSSLLTFGGGTKLEIK |
| CAR22-31 | 770 QSVLTQPRSVSGSPGQSVTISCTGTSSDVGGYNYVSWYQQHPGEAPKLIIYDADKRPSGIS NRFSSGKSGNTASLTISGLQVEDEADYYCCSYAGGSTWVFGGGTKVTVL |
| CAR22-32 | 771 EIVLTQSPATLSVSPGERATLSCRASQSVTSNLAWYQQKPGQAPRLLIYAASTRATGIPAR FSGSGSGTEFTLTISSMQSEDFAVYFCQQYHTWPPLTFGGGTKVEIKT |
| CAR22-33 | 772 DVVMTQSPLSLPVTPGEPASISCRSSQSLLHSNGYNYLDWYLQKPGQSPQLLIYLGSNRAS GVPDRFSGSGSGTDFTLKISRVEAEDVGVYYCMQALQTPWTFGQGTKLEIK |
| CAR22-34 | 773 EIVLTQSPLSLPVTPGEPASISCRSSQSLLYSDGYNYLDWYLQKPGQSPQLLIYLGSNRASG VPDRFSGSGSGTDFTLQISGVETEDVGVYYCMQALQTQSFGQGTKLEIK |
| CAR22-35 | 774 SSELTQDPAVSVALGQTARITCQGDSLRSYFTSWYHQKPGQAPVLVIYGNNNRPSGIPDRF SGSSSGNTASLTITGAQAEDEGDYYCDSRDSSGDHLVFGGGTKLTVL |
| CAR22-36 | 775 SSELTQDPAVSVALGQTVRITCQGDSLRSYYASWYQQKPGQAPVLVIYGKNNRPSGIPDR FSGSSSGNTASLTITGAQAEDEADYYCNSRDSSGNHPVVFGGGTKLTVL |
| CAR22-37 | 776 QSALTQPASVSGSPGQSITISCTGTSSDVGGYKHVSWYQHHPGKAPKLMIYDVSNRPSGV SNRFSGSKSGNTASLTVSGLQAEDEAHYYCVSYRNFNSLVFGTGTKVTVL |
| CAR22-38 | 777 QSALTQPASVSGSPGQSITISCTGTSSDVGGYNYVSWYQQHPGKAPKLMIYEVSNRPSGVS NRFSGSKSGNTASLTISGLQAEDEADYYCSSYTSSSTLVFGTGTQLTVL |

TABLE 10B

Light Chain Variable Regions of CD22 antibody molecules

| Candidate | ID | Light Chain Variable region |
|---|---|---|
| CAR22-53 | 681 | QSALTQPASVSGSPGQSITISCTGTSSDVGGYNYVSWYQQHPGKAPKVIISEVNNRPSGVSHRFSGSKSGNTASLTISGLQAEDEADYFCSSYTSGRTLYVFGTGSKVTVLG |
| CAR22-57 | 682 | QSALTQPASVSGSPGQSITISCTGSRNDIGAYESVSWYQQHPGNAPKLIIHGVNNRPSGVFDRFSVSQSGNTASLTISGLQAEDEADYYCSSHTTTSTLYVFGTGTKVTVLG |
| CAR22-58 | 683 | QSALTQPASVSGSPGQSITISCTGSSSDVGGYNSVSWYQQHPGKAPKLMIYEVINRPSGVSHRFSGSKSGNTASLTISGLQAEDEADYYCSSYTSSSTYVFGTGTKVTVLG |
| CAR22-59 | 684 | QSALTQPASVSGSPGQSITISCTGSSSDIGGFNYVSWYQQHAGEAPKLMIYEVTNRPSGVSDRFSGSKSDNTASLTISGLQAEDEADYYCSSYASGSPLYVFGTGTKVTVLG |
| CAR22-60 | 685 | QSALTQPASVSGSPGQSITFSCTGTSSDIGGYNYVSWYQQHPGKAPKLMIYEVSNRPSGVSNRFSGTKSGNTASLTISGLQAEDEADYYCSSYTSSSTLYVFGTGTKLTVLG |
| CAR22-61 | 686 | QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLYVFGTGTKVTVLG |
| CAR22-62 | 687 | QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLYVFGTGTKVTVLG |
| CAR22-63 | 688 | QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLYIFGTGTKVTVLG |
| CAR22-64 | 689 | QSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVL |
| CAR22-65 | 690 | QSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVL |

In some embodiments, the antigen binding domain comprises a HC CDR1, a HC CDR2, and a HC CDR3 of any heavy chain binding domain amino acid sequences listed in Table 9A or 9B. In embodiments, the antigen binding domain further comprises a LC CDR1, a LC CDR2, and a LC CDR3. In embodiments, the antigen binding domain comprises a LC CDR1, a LC CDR2, and a LC CDR3 of any light chain binding domain amino acid sequences listed in Table 10A or 10B.

In some embodiments, the antigen binding domain comprises one, two or all of LC CDR1, LC CDR2, and LC CDR3 of any light chain binding domain amino acid sequences listed in Table 10A or 10B, and one, two or all of HC CDR1, HC CDR2, and HC CDR3 of any heavy chain binding domain amino acid sequences listed in Table 9A or 9B.

In some embodiments, the CDRs are defined according to the Kabat numbering scheme, the Chothia numbering scheme, or a combination thereof.

The order in which the VL and VH domains appear in the scFv can be varied (i.e., VL-VH, or VH-VL orientation), and where either three or four copies of the "G4S" (SEQ ID NO:18) subunit, in which each subunit comprises the sequence GGGGS (SEQ ID NO:18) (e.g., (G4S)$_3$ (SEQ ID NO:107) or (G4S)$_4$(SEQ ID NO:106)), can connect the variable domains to create the entirety of the scFv domain. Alternatively, the CAR construct can include, for example, a linker including the sequence GSTSGSGKPGSGEG-STKG (SEQ ID NO: 1322).

These clones all contained a Q/K residue change in the signal domain of the co-stimulatory domain derived from CD3zeta chain.

CAR20 Constructs

Anti-CD20 single chain variable fragments were isolated. See Table 11A and 11B. Anti-CD20 scFvs were cloned into lentiviral CAR expression vectors with the CD3zeta chain and the 4-1BB costimulatory molecule. CAR-containing plasmids were amplified by bacterial transformation in STBL3 cells, followed by Maxiprep using endotoxin-free Qiagen Plasmid Maki kit. Lentiviral supernatant was produced in 293T cells using standard techniques.

The sequences of the CARs are provided below in Tables 11A and 11B. Additional components of CARs (e.g., leader, hinge, transmembrane, and signalling domains) are described herein.

TABLE 11A

Rat CD20 CAR Constructs

| Name | SEQ ID NO: | Sequence |
|---|---|---|
| CAR20-1 scFv domain | 800 | qiqlvqsgpelkkpgesvkiscktseytftdyafhwvkqapgkglkwmgwintysgkpt yaddfkgrfvfsledsartanlqisnlknedtatyfcargayygyrdwftywgqgtlvtvssg gggsgggsgggsgggsgggsdivmtqtpssqavsagekvtmsckssqsllysenkknyla wyqqkpgqspklliywastresgvpdrfigsgsgtdftltissvqaedlavyycqqyynfp pwtfggtklelk |
| CAR20-1 scFv | 801 | caaattcaactggtccagtccggccctgagctgaagaagccgggagaatccgtgaagatctc ctgcaagacctcggagtacaccttcactgactacgccttccactgggtcaagcaggcacctgg |

TABLE 11A-continued

Rat CD20 CAR Constructs

| Name | SEQ ID NO: | Sequence |
|---|---|---|
| domain nt | | gaaaggcctgaagtggatgggctggatcaacacttactcggggaagccaacctacgccgat<br>gatttcaagggaagattcgtgtttagcctggaggactccgcccggacagctaacctccaaatct<br>ccaaccttaagaacgaggacactgcgacctacttctgcgcgcggggagcctattacggttatc<br>gcgactggttcacctactggggacagggcaccctcgtgaccgtgtcctccggcggtggaggc<br>tcagggggggcggctcgggagggggtggaagcggaggaggaggctccgatattgtgat<br>gacccagacccgtcgagccaggcagtgtccgctggagaaaggtcaccatgtcctgcaag<br>agctcacagtccctgttgtactccgaaaacaagaagaattacctggcctggtaccagcagaag<br>cccggacagtcccctaaactgctgatctactgggcctcgactagggaatctggcgtgcccgac<br>cgctttatcggaagcggttcagggactgacttcacccctgaccattagcagcgtgcaggccgag<br>gacctggcggtgtactactgtcaacagtactacaacttcccgccctggacttttcggcggtggaa<br>cgaagctcgaactcaag |
| CAR20-1 Soluble scFv - nt | 802 | atggccctccctgtcaccgccctgctgcttccgctggctcttctgctccacgccgctcggcccc<br>aaattcaactggtccagtccggccctgagctgaagaagccgggagaatccgtgaagatctcct<br>gcaagacctcggagtacaccttcactgactacgccttccactgggtcaagcaggcacctggg<br>aaaggcctgaagtggatgggctggatcaacacttactcggggaagccaacctacgccgatga<br>tttcaagggaagattcgtgtttagcctggaggactccgcccggacagctaacctccaaatctcc<br>aaccttaagaacgaggacactgcgacctacttctgcgcgcggggagcctattacggttatcgc<br>gactggttcacctactggggacagggcaccctcgtgaccgtgtcctccggcggtggaggctc<br>agggggggcggctcgggagggggtggaagcggaggaggaggctccgatattgtgatga<br>cccagacccgtcgagccaggcagtgtccgctggagaaaggtcaccatgtcctgcaagag<br>ctcacagtccctgttgtactccgaaaacaagaagaattacctggcctggtaccagcagaagcc<br>cggacagtcccctaaactgctgatctactgggcctcgactagggaatctggcgtgcccgacc<br>gctttatcggaagcggttcagggactgacttcacccctgaccattagcagcgtgcaggccgagg<br>acctggcggtgtactactgtcaacagtactacaacttcccgccctggacttttcggcggtggaac<br>gaagctcgaactcaagggatcgcaccaccatcaccatcatcac |
| CAR20-1 Soluble scFv - aa | 803 | malpvtalllplalllhaarpqiqlvqsgpelkkpgesvkiscktseytftdyafhwvkqapg<br>kglkwmgwintysgkptyaddfkgrfvfsledsartanlqisnlknedtatyfcargayyg<br>yrdwftywgqgtlvtvssggggsggggsggggsggggsdivmtqtpssqavsagekvt<br>msckssqsllysenkknylawyqqkpgqspkllIyswastresgvpdrfigsgsgtdftltis<br>svqaedlavyycqqyynfppwtfgggtklelkgshhhhhhhh |
| CAR20-1 Full - nt lentivirus | 804 | atggccctccctgtcaccgccctgctgcttccgctggctcttctgctccacgccgctcggcccc<br>aaattcaactggtccagtccggccctgagctgaagaagccgggagaatccgtgaagatctcct<br>gcaagacctcggagtacaccttcactgactacgccttccactgggtcaagcaggcacctggg<br>aaaggcctgaagtggatgggctggatcaacacttactcggggaagccaacctacgccgatga<br>tttcaagggaagattcgtgtttagcctggaggactccgcccggacagctaacctccaaatctcc<br>aaccttaagaacgaggacactgcgacctacttctgcgcgcggggagcctattacggttatcgc<br>gactggttcacctactggggacagggcaccctcgtgaccgtgtcctccggcggtggaggctc<br>agggggggcggctcgggagggggtggaagcggaggaggaggctccgatattgtgatga<br>cccagacccgtcgagccaggcagtgtccgctggagaaaggtcaccatgtcctgcaagag<br>ctcacagtccctgttgtactccgaaaacaagaagaattacctggcctggtaccagcagaagcc<br>cggacagtcccctaaactgctgatctactgggcctcgactagggaatctggcgtgcccgacc<br>gctttatcggaagcggttcagggactgacttcacccctgaccattagcagcgtgcaggccgagg<br>acctggcggtgtactactgtcaacagtactacaacttcccgccctggacttttcggcggtggaac<br>gaagctcgaactcaagaccactaccccagcaccgaggccaccaccccggctcctaccatc<br>gcctcccagcctctgtccctgcgtccggaggcatgtagacccgcagctggtggggccgtgca<br>tacccggggtcttgacttcgcctgcgatatctacatttgggcccctctggctggtacttgcgggg<br>tcctgctgctttcactcgtgatcactctttactgtaagcgcggtcggaagaagctgctgtacatctt<br>taagcaaccccttcatgaggcctgtgcagactactcaagaggaggacggctgttcatgccggtt<br>cccagaggaggaggaaggcggctgcgaactgcgcgtgaaattcagccgcagcgcagatgc<br>tccagcctacaagcaggggcagaaccagctctacaacgaactcaatcttggtcggagagag<br>gagtacgacgtgctggacaagcggagaggacgggacccagaaatgggcgggaagccgc<br>gcagaaagaatcccaagagggcctgtacaacgagctccaaaaggataagatggcagaag<br>cctatagcgagattggtatgaaagggaacgcagaagaggcaaaggccacgacggactgta<br>ccagggactcagcaccgccaccaaggacacctatgacgctcttcacatgcaggccctgccg<br>cctcgg |
| CAR20-1 - Full - aa | 805 | malpvtalllplalllhaarpqiqlvqsgpelkkpgesvkiscktseytftdyafhwvkqapg<br>kglkwmgwintysgkptyaddfkgrfvfsledsartanlqisnlknedtatyfcargayyg<br>yrdwftywgqgtlvtvssggggsggggsggggsggggsdivmtqtpssqavsagekvt<br>msckssqsllysenkknylawyqqkpgqspkllIyswastresgvpdrfigsgsgtdftltis<br>svqaedlavyycqqyynfppwtfgggtklelkttttpaprpptpaptiasqplslrpeacrpaa<br>ggavhtrgldfacdiyiwaplagtcgvlllslvitlyckrgrkkllyifkqpfmrpvqttqeed<br>gcscrfpeeeeggcelrvkfsrsadapaykqgqnqlynelnlgrreeydvldkrrgrdpem<br>ggkprrknpqeglynelqkdkmaeayseigmkgerrrgkghdglyqglstatkdtydal<br>hmqalppr |
| CAR20-2 scFv domain | 806 | evqlvesggglvqpgrslklsclasgftfskygmnwirqapgkglewvasisstsiyiyyad<br>tvkgrftisrenakntlylqmtslrsedtalyycarhdyssysywgqgvmvtvssggggsg<br>gggsggggsggggsqvvltqpksvstslestvklsckinsgngisyfihwyqqhegrsptt<br>miyrddkrphgvpdrfsgsidsssnsafltinnvqtedeaiyfchsydsginivfgggtkltvl |

TABLE 11A-continued

Rat CD20 CAR Constructs

| Name | SEQ ID NO: | Sequence |
|---|---|---|
| CAR20-2 scFv domain - nt | 807 | gaggtgcagctcgtcgaatccggtggaggactggtgcagccaggaagatccctgaagctgt cctgtctcgcctcgggcttcactttctccaaatacggcatgaattggattcgccaggcaccgg aaaggggctggaatgggtggccagcatcagctcgactagcatctacatctactatgccgatac cgtcaagggccgcttcactatctcccgcgagaacgctaagaacacccttacttgcaaatgacc tccctgaggtccgaagataccgccctgtactattgcgcccggcacgactactcatcctactcct actgggacagggagtcatggtgaccgtgtcctccggcggtggaggctcaggggggggcg gctcggggaggggtggaagcggaggaggaggctcccaagtcgtgctgacgcaacccaagt ccgtgagcaccagcctggagagcaccgtgaagctcagctgcaagattaactcgggcaacatt gggtcctacttcatccattggtaccagcagcacgaaggacggtcccctaccactatgatctacc gggacgacaagcggccgcacggagtgccggacagattctcggttcaatcgattcctcatct aactcggcgtttctcaccatcaacaacgtgcagaccgaggacgaagcgatctacttctgccac tcctacgactcgggtattaacattgtgttcggcggcgggactaagctgacagtgctg |
| CAR20-2 - Soluble scFv - nt | 808 | atggccctccctgtcaccgccctgctgcttccgctggctcttctgctccacgccgctcggcccg aggtgcagctcgtcgaatccggtggaggactggtgcagccaggaagatccctgaagctgtcc tgtctcgcctcgggcttcactttctccaaatacggcatgaattggattcgccaggcaccggaa aggggctggaatgggtggccagcatcagctcgactagcatctacatctactatgccgataccg tcaagggccgcttcactatctcccgcgagaacgctaagaacacccttttacttgcaaatgacctc cctgaggtccgaagataccgccctgtactattgcgcccggcacgactactcatcctactcctac tgggacagggagtcatggtgaccgtgtcctccggcggtggaggctcaggggggggcggc tcggggaggggtggaagcggaggaggaggctcccaagtcgtgctgacgcaacccaagtcc gtgagcaccagcctggagagcaccgtgaagctcagctgcaagattaactcgggcaacattgg gtcctacttcatccattggtaccagcagcacgaaggacggtcccctaccactatgatctaccgg gacgacaagcggccgcacggagtgccggacagattctcggttcaatcgattcctcatcatctaac tcggcgtttctcaccatcaacaacgtgcagaccgaggacgaagcgatctacttctgccactcct acgactcgggtattaacattgtgttcggcggcgggactaagctgacagtgctgggatcgcacc accatcaccatcatcatcac |
| CAR20-2 - Soluble scFv - aa | 809 | malpvtalllplalllhaarpevqlvesggglvqpgrslklsclasgftfskygmnwirqapg kglewvasisstsiyiyyadtvkgrftisrenakntlylqmtslrsedtalyycarhdyssysy wgqgvmvtvssggggsggggsggggsggggsqvvltqpksvstslestvklsckinsgn igsyfihwyqqhegrspttmiyrddkrphgvpdrfsgsidsssnsafltinnvqtedeaiyf chsydsginivfgggtkltvlgshhhhhhhh |
| CAR20-2 - Full - nt | 810 | atggccctccctgtcaccgccctgctgcttccgctggctcttctgctccacgccgctcggcccg aggtgcagctcgtcgaatccggtggaggactggtgcagccaggaagatccctgaagctgtcc tgtctcgcctcgggcttcactttctccaaatacggcatgaattggattcgccaggcaccggaa aggggctggaatgggtggccagcatcagctcgactagcatctacatctactatgccgataccg tcaagggccgcttcactatctcccgcgagaacgctaagaacacccttttacttgcaaatgacctc cctgaggtccgaagataccgccctgtactattgcgcccggcacgactactcatcctactcctac tgggacagggagtcatggtgaccgtgtcctccggcggtggaggctcaggggggggcggc tcggggaggggtggaagcggaggaggaggctcccaagtcgtgctgacgcaacccaagtcc gtgagcaccagcctggagagcaccgtgaagctcagctgcaagattaactcgggcaacattgg gtcctacttcatccattggtaccagcagcacgaaggacggtcccctaccactatgatctaccgg gacgacaagcggccgcacggagtgccggacagattctcgggttcaatcgattcctcatcatctaac tcggcgtttctcaccatcaacaacgtgcagaccgaggacgaagcgatctacttctgccactcct acgactcgggtattaacattgtgttcggcggcgggactaagctgacagtgctgaccactaccc cagcaccgaggccacccaccccggctcctaccatcgcctcccagcctctgtccctgcgtccg gaggcatgtagaccccgcagctggtggggccgtgcataccccgggtcttgacttcgcctgcga tatctacatttgggcccctctggctggtacttgcggggtcctgctgctttcactcgtgatcactcttt actgtaagcgcggtcggaagaagctgctgtacatcttttaagcaaccctcatgaggcctgtgca gactactcaagaggaggacggctgttcatgccggttcccagaggaggaggaaggcggctgc gaactgcgcgtgaaattcagccgcagcgacatgctccagcctacaagcaggggcagaacc agctctacaacgaactcaatcttggtcggagagaggagtacgacgtgctggacaagcggag aggacgggacccagaaatgggcggaagccgcgcagaaagaatcccaagagggcctgt acaacgagctccaaaaggataagatggcagaagcctatagcgagattggtatgaaagggga acgcagaagaggcaaaggccacgacggactgtaccagggactcagcaccgccaccaagg acacctatgacgctcttcacatgcaggccctgccgcctcgg |
| CAR20-2 - Full - aa | 811 | malpvtalllplalllhaarpevqlvesggglvqpgrslklsclasgftfskygmnwirqapg kglewvasisstsiyiyyadtvkgrftisrenakntlylqmtslrsedtalyycarhdyssysy wgqgvmvtvssggggsggggsggggsggggsqvvltqpksvstslestvklsckinsgn igsyfihwyqqhegrspttmiyrddkrphgvpdrfsgsidsssnsafltinnvqtedeaiyf chsydsginivfgggtkltvltttpaprpptpaptiasqplslrpeacrpaaggavhtrgldfac diyiwaplagtcgvlllslvitlyckrgrkkllyifkqpfmrpvqttqeedgcscrfpeeeegg celrvkfsrsadapaykqgqnqlynelnlgrreeydvldkrrgrdpemggkprrknpqeg lynelqkdkmaeayseigmkgerrrgkghdglyqglstatkdtydalhmqalppr |
| CAR20-3 scFv domain | 812 | evqlvesggglvqpgrslklscaasgftfrdyymawvrqapkkglewvasisyegnpyy gdsvkgrftisrnnakstlylqmnslrsedtatyycarhdhnnvdwfaywgqgtlvtvssg gggsggggsggggsggggsdivmtqtpssqavsagekvtmsckssqsllysenkknyla wyqqkpgqspkllifwastresgvpdrfigsgsgtdftltissvqaedlavyycqqyynfpt fgsgtkleik |

TABLE 11A-continued

Rat CD20 CAR Constructs

| Name | SEQ ID NO: | Sequence |
|---|---|---|
| CAR20-3 scFv domain nt | 813 | gaagtgcagcttgtggagtctggcggcggtctggtgcagccgggaagatccctgaagctgtc atgcgccgcgtccgggtttaccttccgcgattactacatggcctgggtcagacaggcacctaa gaaggggctggaatgggtggcatccatctcatatgaaggaaacccgtactacggagactcgg tgaaaggccgcttcactatctcacggaacaacgctaagagcacgctgtacttgcaaatgaact ccctccggtcggaggacacagccacttactactgtgcccggcacgaccataacaacgtcgatt ggttcgcctactgggtcaaggaaccctcgtgaccgtgtcctccggcggtggaggctcaggg ggggcggctcggaggggtggaagcggaggaggaggctccgacatcgtgatgactca gactccaagcagccaggccgtgtccgccgagagaaagtcaccatgtcgtgcaagagctcc cagtccctgctgtactccgaaaacaagaagaattatctcgcctggtaccagcagaagcctgga cagtccccgaagctcctgatcttttgggcgtcgaccaggaatccggcgtgcccgatcgcttc attggctccggttccggcaccgacttcaccctgaccattagcagcgtccaggcggaggacct ggctgtgtactactgccaacagtactacaacttccccactttcggatcggggaccaagctgga gatcaag |
| CAR20-3 - Soluble scFv - nt | 814 | atggccctccctgtcaccgccctgctgcttccgctggctcttctgctccacgccgctcggcccg aagtgcagcttgtggagtctggcggcggtctggtgcagccgggaagatccctgaagctgtca tgcgccgcgtccgggtttaccttccgcgattactacatggcctgggtcagacaggcacctaag aaggggctggaatgggtggcatccatctcatatgaaggaaacccgtactacggagactcggt gaaaggccgcttcactatctcacggaacaacgctaagagcacgctgtacttgcaaatgaactc cctccggtcggaggacacagccacttactactgtgcccggcacgaccataacaacgtcgatt ggttcgcctactgggtcaaggaaccctcgtgaccgtgtcctccggcggtggaggctcaggg ggggcggctcggaggggtggaagcggaggaggaggctccgacatcgtgatgactca gactccaagcagccaggccgtgtccgccgagagaaagtcaccatgtcgtgcaagagctcc cagtccctgctgtactccgaaaacaagaagaattatctcgcctggtaccagcagaagcctgga cagtccccgaagctcctgatcttttgggcgtcgaccaggaatccggcgtgcccgatcgcttc attggctccggttccggcaccgacttcaccctgaccattagcagcgtccaggcggaggacct ggctgtgtactactgccaacagtactacaacttccccactttcggatcggggaccaagctgga gatcaagggatcgcaccaccatcaccatcatcatcac |
| CAR20-3 - Soluble scFv - aa | 815 | malpvtalllplalllhaarpevqlvesgggglvqpgrslklscaasgftfrdyymawvrqap kkglewvasisyegnpyygdsvkgrftisrnnakstlylqmnslrsedtatyycarhdhnn vdwfaywgqgtlvtvssgggggsggggsggggsggggsdivmtqtpssqavsagekvt mscksssqsllysenkknylawyqqkpgqspkllifwastresgvpdrfigsgsgtdftltiss vqaedlavyycqqyynfptfgsgtkleikgshhhhhhhh |
| CAR20-3 - Full - nt | 816 | atggccctccctgtcaccgccctgctgcttccgctggctcttctgctccacgccgctcggcccg aagtgcagcttgtggagtctggcggcggtctggtgcagccgggaagatccctgaagctgtca tgcgccgcgtccgggtttaccttccgcgattactacatggcctgggtcagacaggcacctaag aaggggctggaatgggtggcatccatctcatatgaaggaaacccgtactacggagactcggt gaaaggccgcttcactatctcacggaacaacgctaagagcacgctgtacttgcaaatgaactc cctccggtcggaggacacagccacttactactgtgcccggcacgaccataacaacgtcgatt ggttcgcctactgggtcaaggaaccctcgtgaccgtgtcctccggcggtggaggctcaggg ggggcggctcggaggggtggaagcggaggaggaggctccgacatcgtgatgactca gactccaagcagccaggccgtgtccgccgagagaaagtcaccatgtcgtgcaagagctcc cagtccctgctgtactccgaaaacaagaagaattatctcgcctggtaccagcagaagcctgga cagtccccgaagctcctgatcttttgggcgtcgaccaggaatccggcgtgcccgatcgcttc attggctccggttccggcaccgacttcaccctgaccattagcagcgtccaggcggaggacct ggctgtgtactactgccaacagtactacaacttccccactttcggatcggggaccaagctgga gatcaagaccactaccccagcaccgaggccacccaccccggctcctaccatcgcctcccag cctctgtccctgcgtccggaggcatgtagacccgcagctggtggggccgtgcataccccggg gtcttgacttcgcctcgcgatatctacatttgggcccctctggctggtacttgcggggtcctgctgc tttcactcgtgatcactctttactgtaagcgcggtcggaagaagctgctgtacatctttaagcaac ccttcatgaggcctgtgcagactactcaagaggaggacggctgttcatgccggttcccagagg aggaggaaggcgaactgcgcgtgaaattcagccgcagcgcagatgctccagccta caagcaggggcagaaccagctctacaacgaactcaatcttggtcggagagaggagtacgac gtgctggacaagcggagaggacgggacccagaaatgggcgggaagccgcgcagaaaga atccccaagagggcctgtacaacgagctccaaaaggataagatggcagaagcctatagcga gattggtatgaaaggggaacgcagaagaggcaaaaggccacgacggactgtaccagggact cagcaccgccaccaaggacacctatgacgctcttcacatgcaggccctgccgcctcgg |
| CAR20-3 - Full - aa | 817 | malpvtalllplalllhaarpevqlvesgggglvqpgrslklscaasgftfrdyymawvrqap kkglewvasisyegnpyygdsvkgrftisrnnakstlylqmnslrsedtatyycarhdhnn vdwfaywgqgtlvtvssgggggsggggsggggsggggsdivmtqtpssqavsagekvt mscksssqsllysenkknylawyqqkpgqspkllifwastresgvpdrfigsgsgtdftltiss vqaedlavyycqqyynfptfgsgtkleiktttpaprpptpaptiasqplslrpeacrpaagga vhtrgldfacdiyiwaplagtcgvlllslvitlyckrgrkllyifkqpfmrpvqttqeedgcs crfpeeeeggcelrvkfsrsadapaykqgqnqlynelnlgrreeydvldkrrgrdpemgg kprrknpqeglynelqkdkmaeayseigmkgerrrgkhdglyqglstatkdtydalhm qalppr |
| CAR20-4 scFv domain | 818 | qvtlkesgpgilqpsqtlsltctftrfslstygmsvgwirqpsgkglewladiwddkhyn pslknrltiskdtsknqaflkitnvdtadtatyycarssttdgivtyvmdvwgqgasvtvssg gggsggggsggggsggggsdvqmtqspsslsasvgdavtinckasqninrylnwyqqkl gegprlliysanslqtgipsrfsgsgsgadftltitspqpedvatyfclqhnswpltfgsgtkleik |

TABLE 11A-continued

Rat CD20 CAR Constructs

| Name | SEQ ID NO: | Sequence |
|---|---|---|
| CAR20-4 scFv domain nt | 819 | caagtcacgctgaaggaatcgggccctggaattctgcagccaagccagaccctctcgcttact tgcaccttcacccgcttctcactgtccacttacggaatgtccgtgggatggattcggcagccca gcggaaagggtttggagtggctggccgacatttgtgggatgacgacaagcattacaaccct agcctgaagaatcggctcaccatcagcaaagacacctccaagaaccaggccgttcctgaagat caccaacgtggataccgccgacactgcaacatactattgtgcccgctcctcaaccaccgatgg gatcgtgacctacgtgatggacgtctgggccagggagcttccgtgaccgtgtcctccggcg gtggaggctcagggggggcggctcggagggggtggaagcggaggaggaggctccga cgtgcagatgactcagtccccgtcgctcctgccgcctccgtcggcgacgccgtgactattaa ctgcaaggcgtcccagaacatcaatcggtacctgaactggtaccagcaaaaactgggagaag ggccgagacttcatctactccgccaaclccctgcaaactggcatcccgtcgaggttcagcg gatcaggctctggtgccgacttcactttgaccatcacgagccctcagcccgaagatgtggcca cctacttctgcctccaacacaactcctggcccctgacctttggttcgggcaccaagctggagat caag |
| CAR20-4 - Soluble scFv - nt | 820 | atggccctccctgtcaccgccctgctgcttccgctggctcttctgctccacgccgctcggcccc aagtcacgctgaaggaatcgggccclggaattctgcagccaagccagaccctctcgcttact gcaccttcacccgcttctcactgtccacacggaatgtcgtgggatggaccggcagcccag cggaaagggtttggagtggctggccgacatttgtgggatgacgacaagcattacaaccccta gcctgaagaatcggctcaccalcagcaaagacacctccaagaaccaggccgttcctgaagatc accaacgtggataccgccgacactgcaacatactattgtgcccgctcctcaaccaccgatggg atcgtgacctacgtgatggacgtctgggccagggagcttccgtgaccgtgtcctccggcggt ggaggclcagggggggcggctcgggagggggtggaagcggaggaggaggctccgac gtgcagalgactcagtccccgtcgctcctgtccgcctccgtcggcgacgccgtgactattaact gcaaggcgcccagaacatcaatcggtaccgaactggtaccagcaaaaactgggagaagg gccgagacttctcatctactccgccaactccctgcaaactggcatcccgtcgaggttcagcgg atcaggctctggtgccgacttcactttgaccatcacgagccctcagcccgaagatgtggccac ctaccctgcctccaacacaactcctggcccctgacctttggccgggcaccaagctggagatc aagggatcgcaccaccatcaccatcatcatcac |
| CAR20-4- Soluble scFv - aa | 821 | malpvtalllplalllhaarpqvllkcsgpgilqpsqdsltctftrfslstygmsvgwirqpsgk glewladiwwdddkhynpslknrltiskdlsknqankitnvdladtatyycarssttdgivt yvmdvwgqgasvtvssggggsggggsggggsggggsdvqmtqspsllsasvgdavti nckasqninrylnwyqqklgegprlliysanslqlgipsrfsgsgsgadflllispqpcdva yfclqhnswpltfgsglkleikgshhhhhhh |
| CAR20 - 4 - Full - nt | 822 | atggccctccctgtcaccgccctgctgcttccgctggctcttctgctccacgccgctcggcccc aagtcacgctgaaggaatcgggccctggaattctgcagccaagccagaccctctcgcttact gcaccttcacccgcttctcactgtccacttacggaatgtccgtgggatggattcggcagcccag cggaaagggtttggagtggctggccgacactggtgggalgacgacaagcattacaaccta gcctgaagaatcggctcaccatcagcaaagacacdccaagaaccaggcgttcctgaagatc accaacgtggataccgccgacactgcaacatactattgtgcccgctcctcaaccaccgatggg atcgtgacctacgtgatggacgtctgggccagggagcttccgtgaccgtgtcctccggcggt ggaggctcagggggggcggctcgggagggggtggaagcggaggaggaggctccgac gtgcagatgactcagtccccgtcgctcctgtccgcctccgtcggcgacgccgtgactattaact gcaaggcgtcccagaacatcaatcggtacctgaactggtaccagcaaaaactgggagaagg gccgagacttctcatctactccgccaactccctgcaaactggcatcccgtcgaggttcagcgg atcaggctctggtgccgacttcactttgaccatcacgagccctcagcccgaagatgtggccac ctacttctgcctccaacacaactcctggcccctgacctttggttcgggcaccaagctggagatc aagaccactacccagcaccgaggccaccaccccggctcctacctaccatcgcctcccagcctct gtccctgcgtccggaggcatgtagacccgcagctggtgggggcgtgcataccggggtccg acttcgcctgcgatatctacatttgggcccctctggctggtacttgcggggtcctgctgctttcac tcglgatcactcctactgtaagcgcggtcggaagaagctgctgtacatcttaagcaaccttca tgaggcctgtgcagactactcaagaggaggacggctgttcatgccggttcccagaggagga ggaaggcggctgcgaactgcgcgtgaaattcagccgcagcgcagatgctccagcctacaag cagggcagaaccagccctacaacgaactcaatcttggtcggagagaggagtacgacgggct ggacaagcgagaggacgggacccagaaatgggcgggaagccgcgcagaaagaatccc caagagggcctgtacaacgagctccaaaaggataagatgcagaagcctatagcgagattg gtatgaaaggggaacgcagaagaggcaaaggccacgacggactgtaccagggactcagc accgccaccaaggacacctatgacgctcttcacatgcaggccctgccgcctcgg |
| CAR20-4 - Full - aa | 823 | malpvtalllplalllhaarpqvtlkesgpgilqpsqtlsltctftrfslstygmsvgwirqpsgk glewladiwwdddkhynpslknrltiskdtsknqaflkitnvdtadtatyycarssttdgivt yvmdvwgqgasvtvssggggsggggsggggsggggsdvqmtqspsllsasvgdavti nckasqninrylnwyqqklgegprlliysanslqtgipsrfsgsgsgadftltitspqpedvat yfclqhnswpltfgsgtkleikttttpaprpptpaptiasqplslrpeacrpaaggavhtrgldfa cdiyiwaplagtcgvllslvitlyckrgrkkllyifkqpfmrpvqttqeedgcscrfpeeeeg gcelrvkfsrsadapaykqgqnqlynelnlgrreeydvldkrrgrdpemggkprrknpqe glynelqkdkmaeayseigmkgerrrgkghdglyqglstatkdtydalhmqalppr |
| CAR20-5 scFv domain | 824 | evqlvesggglvqpgtslklscvasgftfsssgmqwirqapkkglewisgiyydsykksy adsvkgrftisrdnskntlylemnslrsedtatyycaksayygykdyfdywgqgvmvtvs sggggsggggsggggsggggsdiqmtqsppslsaslgdkvtitcqasqninkyiawyqq kpgkaprlliirytstlesgtpsrfsgsgsgrdysfsisnvesgdvasyyclqyddlpytfgpgt klelk |

TABLE 11A-continued

Rat CD20 CAR Constructs

| Name | SEQ ID NO: | Sequence |
| --- | --- | --- |
| CAR20-5 scFv domain nt | 825 | gaggtccagcttgtggaatcaggaggcggactcgtccagccgggtactagcctgaagctcag<br>ctgtgtggccagcggttttaccttctcgtcctccgggatgcagtggattcggcaggctcccaag<br>aagggactggaatggatctcgggcatctactacgactcgtacaagaagtcctacgccgattcc<br>gtgaaaggtcgcttcaccatctcccgggacaacagcaagaacactctgtacctcgagatgaac<br>tccttgcgctccgaggataccgcaacctattactgcgccaagtcggcctactacggctacaag<br>gactacttcgactattggggccagggagtgatggtgaccgtgtcctccggcggtggaggctc<br>agggggggggcggctcggagggggtggaagcggaggaggaggctccgacatccaaatg<br>acacagtcaccccttctctttccgcgagcctgggagataaggtcaccattacgtgccaagcgt<br>cccagaacatcaacaagtacatcgcctggtaccagcagaaacccgggaaaggccccgcggct<br>gctgattagatacacctcgactctggaatccggcactccatcaagattcagcggctccggcag<br>cggagggactactcgttctccatctccaatgtggagtccggggacgtggccagctactattg<br>cctgcaatacgacgatctgccctacaccttcggacctggaaccaagctggaactcaag |
| CAR20-5 - Soluble scFv - nt | 826 | atggccctccctgtcaccgccctgctgcttccgctggctcttctgctccacgccgctcggcccg<br>aggtccagcttgtggaatcaggaggcggactcgtccagccgggtactagcctgaagctcag<br>ctgtgtggccagcggttttaccttctcgtcctccgggatgcagtggattcggcaggctcccaaga<br>agggactggaatggatctcgggcatctactacgactcgtacaagaagtcctacgccgattccg<br>tgaaaggtcgcttcaccatctcccgggacaacagcaagaacactctgtacctcgagatgaact<br>ccttgcgctccgaggataccgcaacctattactgcgccaagtcggcctactacggctacaagg<br>actacttcgactattggggccagggagtgatggtgaccgtgtcctccggcggtggaggctca<br>gggggggggcggctcggagggggtggaagcggaggaggaggctccgacatccaaatga<br>cacagtcaccccttctctttccgcgagcctgggagataaggtcaccattacgtgccaagcgtc<br>ccagaacatcaacaagtacatcgcctggtaccagcagaaacccgggaaaggccccgcggct<br>gctgattagatacacctcgactctggaatccggcactccatcaagattcagcggctccggcag<br>cggagggactactcgttctccatctccaatgtggagtccggggacgtggccagctactattg<br>cctgcaatacgacgatctgccctacaccttcggacctggaaccaagctggaactcaagggatc<br>gcaccaccatcaccatcatcac |
| CAR20-5 - Soluble scFv - aa | 827 | malpvtalllplalllhaarpevqlvesggglvqpgtslklscvasgftfsssgmqwirqapk<br>kglewisgiyydsykksyadsvkgrftisrdnskntlylemnslrsedtatyycaksayygy<br>kdyfdywgqgvmvtvssgggggsgggggsggggsggggsdiqmtqsppslsaslgdkvti<br>tcqasqninkyiawyqqkpgkaprllirytstlesgtpsrfsgsgsgrdysfsisnvesgdva<br>syyclqyddlpytfgpgtklelkgshhhhhhhh |
| CAR20-5 - Full - nt | 828 | atggccctccctgtcaccgccctgctgcttccgctggctcttctgctccacgccgctcggcccg<br>aggtccagcttgtggaatcaggaggcggactcgtccagccgggtactagcctgaagctcag<br>ctgtgtggccagcggttttaccttctcgtcctccgggatgcagtggattcggcaggctcccaaga<br>agggactggaatggatctcgggcatctactacgactcgtacaagaagtcctacgccgattccg<br>tgaaaggtcgcttcaccatctcccgggacaacagcaagaacactctgtacctcgagatgaact<br>ccttgcgctccgaggataccgcaacctattactgcgccaagtcggcctactacggctacaagg<br>actacttcgactattggggccagggagtgatggtgaccgtgtcctccggcggtggaggctca<br>gggggggggcggctcggagggggtggaagcggaggaggaggctccgacatccaaatga<br>cacagtcaccccttctctttccgcgagcctgggagataaggtcaccattacgtgccaagcgtc<br>ccagaacatcaacaagtacatcgcctggtaccagcagaaacccgggaaaggccccgcggct<br>gctgattagatacacctcgactctggaatccggcactccatcaagattcagcggctccggcag<br>cggagggactactcgttctccatctccaatgtggagtccggggacgtggccagctactattg<br>cctgcaatacgacgatctgccctacaccttcggacctggaaccaagctggaactcaagggatc<br>ctaccccagcaccgaggccacccaccccggctcctaccatcgcctcccagcctctgtccctg<br>cgtccggaggcatgtagacccgcagctggtggggccgtgcatacccggggtcttgacttcgc<br>ctgcgatatctacatttgggcccctctggctggtacttgcggggtcctgctgcttttcactcgtgat<br>cactctttactgtaagcgcggtcggaagaagctgctgtacatctttaagcaaccccttcatgagc<br>ctgtgcagactactcaagaggaggacggctgttcatgccggttcccagaggaggaggaagg<br>cggctgcgaactgcgcgtgaaattcagccgcagcgcagatgctccagcctacaagcagggg<br>cagaaccagctctacaacgaactcaatcttggtcggagagaggagtacgacgtgctggacaa<br>gcggagaggacgggacccagaaatgggcgggaagccgcgcagaaagaatccccaagag<br>ggcctgtacaacgagctccaaaaggataagatggcagaagcctatagcgagattggtatgaa<br>aggggaacgcagaagaggcaaaggccacgacggactgtaccagggactcagcaccgcca<br>ccaaggacacctatgacgctcttcacatgcaggccctgccgcctcgg |
| CAR20-5 - Full - aa | 829 | malpvtalllplalllhaarpevqlvesggglvqpgtslklscvasgftfsssgmqwirqapk<br>kglewisgiyydsykksyadsvkgrftisrdnskntlylemnslrsedtatyycaksayygy<br>kdyfdywgqgvmvtvssgggggsgggggsggggsggggsdiqmtqsppslsaslgdkvti<br>tcqasqninkyiawyqqkpgkaprllirytstlesgtpsrfsgsgsgrdysfsisnvesgdva<br>syyclqyddlpytfgpgtklelktttpaprpptpaptiasqplslrpeacrpaaggavhtrgld<br>facdiyiwaplagtcgvlllslvitlyckrgrkkllyifkqpfmrpvqttqeedgcscrfpeee<br>eggcelrvkfsrsadapaykqgqnqlynelngrreeydvldkrrgrdpemggkprrknp<br>qeglynelqkdkmaeayseigmkgerrrgkghdglyqglstatkdtydalhmqalppr |
| CAR20-6 scFv domain | 830 | qvtlkesgpgllqpsqtlsltctfagfslnthgmgvgwirqpsgkglewlaniwwdddky<br>ynpslknrltmskdtsnnqaflkitnvdtadtatyycariegspvvttvfdywgqgvmvtv<br>ssgggggsgggggsgggggsggggsdiqmtqspsflsasvgdrvtinckasqninrylnwyq<br>qklgeapkllliynanslqtgipsrfsgsgsgtdftltisslqpadvatyfclqhnsrpltfgsgtil<br>eik |

TABLE 11A-continued

Rat CD20 CAR Constructs

| Name | SEQ ID NO: | Sequence |
|---|---|---|
| CAR20-6 scFv domain nt | 831 | caagtcactcttaaggaatccgggccaggactgttgcagccgagccagaccctgtccctcact<br>tgtaccttcgccggcttttcactgaacacccacggaatgggcgtgggatggattaggcagccc<br>tcgggaaagggactggagtggctggccaacatttggtgggacgacgacaagtattacaaccc<br>gagcctcaagaaccgcctgactatgtccaaggatacctccaacaaccaggccttcctgaaaat<br>cactaacgtggataccgctgacaccgcaacgtactactgcgcccggatcgaaggttccccccg<br>tcgtgacaactgtgttcgactactggggacagggcgtgatggtgaccgtgtcctccggcggtg<br>gaggctcagggggggcggctcggaggggggtggaagcggaggaggaggctccgacat<br>ccaaatgacccagtcacctagctttctgtcggcctcggtcggcgacagagtgaccattaactgc<br>aaaagcgtcccagaacatcaaccgctacctgaattggtaccagcagaagctgggggaagccc<br>cgaagctgctgatctacaacgcgaacagcctccagactggtattcttcccggttctccggga<br>gcggctcgggtaccgatttcaccctcaccatctcctcccttcaacccgctgacgtggccaccta<br>cttctgcttgcaacataattctcggcctctgaccttcggaagcggcactatcctcgagatcaag |
| CAR20-6 - Soluble scFv - nt | 832 | atggccctcctgtcaccgccctgctgcttccgctggctcttctgctccacgccgctcggcccc<br>aagtcactcttaaggaatccgggccaggactgttgcagccgagccagaccctgtccctcactt<br>gtaccttcgccggcttttcactgaacacccacggaatgggcgtgggatggattaggcagccct<br>cgggaaagggactggagtggctggccaacatttggtgggacgacgacaagtattacaaccc<br>gagcctcaagaaccgcctgactatgtccaaggatacctccaacaaccaggccttcctgaaaat<br>cactaacgtggataccgctgacaccgcaacgtactactgcgcccggatcgaaggttccccccg<br>tcgtgacaactgtgttcgactactggggacagggcgtgatggtgaccgtgtcctccggcggtg<br>gaggctcagggggggcggctcggaggggggtggaagcggaggaggaggctccgacat<br>ccaaatgacccagtcacctagctttctgtcggcctcggtcggcgacagagtgaccattaactgc<br>aaaagcgtcccagaacatcaaccgctacctgaattggtaccagcagaagctgggggaagccc<br>cgaagctgctgatctacaacgcgaacagcctccagactggtattcttcccggttctccggga<br>gcggctcgggtaccgatttcaccctcaccatctcctcccttcaacccgctgacgtggccaccta<br>cttctgcttgcaacataattctcggcctctgaccttcggaagcggcactatcctcgagatcaagg<br>gatcgcaccaccatcaccatcatcac |
| CAR20-6 - Soluble scFv - aa | 833 | malpvtalllplalllhaarpqvtlkesgpgllqpsqtlsltctfagfslnthgmgvgwirqpsg<br>kglewlaniwwdddkyynpslknrltmskdtsnnqaflkitnvdtadtatyycariegspv<br>vttvfdywgqgvmvtvssggggsggggsggggsggggsdiqmtqspsflsasvgdrvti<br>nckasqninrylnwyqqklgeapklliynanslqtgipsrfsgsgsgtdftltisslqpadvat<br>yfclqhnsrpltfgsgtileikgshhhhhh |
| CAR20-6 - Full - nt | 834 | atggccctcctgtcaccgccctgctgcttccgctggctcttctgctccacgccgctcggcccc<br>aagtcactcttaaggaatccgggccaggactgttgcagccgagccagaccctgtccctcactt<br>gtaccttcgccggcttttcactgaacacccacggaatgggcgtgggatggattaggcagccct<br>cgggaaagggactggagtggctggccaacatttggtgggacgacgacaagtattacaaccc<br>gagcctcaagaaccgcctgactatgtccaaggatacctccaacaaccaggccttcctgaaaat<br>cactaacgtggataccgctgacaccgcaacgtactactgcgcccggatcgaaggttccccccg<br>tcgtgacaactgtgttcgactactggggacagggcgtgatggtgaccgtgtcctccggcggtg<br>gaggctcagggggggcggctcggaggggggtggaagcggaggaggaggctccgacat<br>ccaaatgacccagtcacctagctttctgtcggcctcggtcggcgacagagtgaccattaactgc<br>aaaagcgtcccagaacatcaaccgctacctgaattggtaccagcagaagctgggggaagccc<br>cgaagctgctgatctacaacgcgaacagcctccagactggtattcttcccggttctccggga<br>gcggctcgggtaccgatttcaccctcaccatctcctcccttcaacccgctgacgtggccaccta<br>cttctgcttgcaacataattctcggcctctgaccttcggaagcggcactatcctcgagatcaaga<br>ccactaccccagcaccgaggccaccacccccggctcctaccatcgcctcccagcctctgtcc<br>ctgcgtccgaggcatgtagacccgcagctggtggggccgtgcatacccggggtcttgactt<br>cgcctgcgatatctacatttgggcccctctggctggtacttgcggggtcctgctgctttcactcgt<br>gatcactctttactgtaagcgcggtcggaagaagctgctgtacatctttaagcaaccttcatga<br>ggcctgtgcagactactaagaggaggacggctgttcatgccggttcccagaggaggagga<br>aggcggctgcgaactgcgcgtgaaattcagccgcagcgcagatgctccagcctacaagcag<br>gggcagaaccagctctacaacgaactcaatcttggtcggagagaggagtacgacgtgctgg<br>acaagcggagaggacgggacccagaaatgggcggaagccgcgcagaaagaatccca<br>agagggcctgtacaacgagctccaaaaggataagatggcagaagcctatagcgagattggta<br>tgaaaggggaacgcagaagaggcaaaggccacgacggactgtaccagggactcagcacc<br>gccaccaaggacacctatgacgctcttcacatgcaggccctgccgcctcgg |
| CAR20-6 - Full - aa | 835 | malpvtalllplalllhaarpqvtlkesgpgllqpsqtlsltctfagfslnthgmgvgwirqpsg<br>kglewlaniwwdddkyynpslknrltmskdtsnnqaflkitnvdtadtatyycariegspv<br>vttvfdywgqgvmvtvssggggsggggsggggsggggsdiqmtqspsflsasvgdrvti<br>nckasqninrylnwyqqklgeapklliynanslqtgipsrfsgsgsgtdftltisslqpadvat<br>yfclqhnsrpltfgsgtileiktttpaprpptpaptiasqplslrpeacrpaaggavhtrgldfac<br>diyiwaplagtcgvlllslvitlyckrgrkkllyifkqpfmrpvqttqeedgcscrfpeeeegg<br>celrvkfsrsadapaykqgqnqlynelnlgrreeydvldkrrgrdpemggkprrknpqeg<br>lynelqkdkmaeayseigmkgerrrgkghdglyqglstatkdtydalhmqalppr |
| CAR20-7 scFv domain | 836 | qvtlkesgpgmlqpsktlsltcsfsgfslstsgmvvswirqpsgkslewlaaiawdgdkyy<br>npslksrvtvskdtsntqvflritsvdiadtatyyctrrdydvgyyyfdfwgqgvmvtvssg<br>gggsggggsggggsggggskivltqsptitaaspgekvtitclassrvsniywyqqksgas<br>pklliystsslasgvpyrfsgsgsgtsysltintmeaedaatyychqwssnpwtfgggtklelk |

TABLE 11A-continued

Rat CD20 CAR Constructs

| Name | SEQ ID NO: | Sequence |
| --- | --- | --- |
| CAR20-7 scFv domain nt | 837 | caagtcaccctgaaagaatcgggtcccggaatgctgcagccatccaagacgctgtcccttaca<br>tgctcctctccggggttcagcctctcaacttccgggatggtggtgtcatggatcagacagccga<br>gcggaaagtccctggagtggctggcggccatcgcatgggatggcgataagtactacaaccc<br>gagcctgaagtcaagggtcactgtgtccaaggacacctccaacacccaagtgttccttcggat<br>cacctccgtggacattgctgacaccgccacctattactgcactcgccgggactacgacgtggg<br>ctactactacttcgatttctggggacagggtgtcatggtgaccgtgtcctccggcggtggaggc<br>tcaggggggggcggctcggggaggggtggaagcggaggaggaggctccaagattgtgct<br>gacccagagccccactattaccgccgcctccccggggggaaaaggtcaccatcacttgtctgg<br>cgtcctcacgcgtgtcgaatatctactggtatcagcagaagtccggcgccagccccaagctgc<br>tgatctactcgacctcctccctcgcgtcgggagtgccttaccggttttctggctcgggaagcgg<br>aaccagctactccttgaccatcaacaccatggaagccgaggacgctgccacttactactgcca<br>ccagtggtcgagcaaccccttggactttcggtggaggcaccaaactcgagctcaag |
| CAR20-7 - Soluble scFv - nt | 838 | atggccctccctgtcaccgccctgctgcttccgctggctcttctgctccacgccgctcggcccc<br>aagtcaccctgaaagaatcgggtcccggaatgctgcagccatccaagacgctgtcccttacat<br>gctcctctccggggttcagcctctcaacttccgggatggtggtgtcatggatcagacagccgag<br>cggaaagtccctggagtggctggcggccatcgcatgggatggcgataagtactacaaccog<br>agcctgaagtcaagggtcactgtgtccaaggacacctccaacacccaagtgttccttcggatc<br>acctccgtggacattgctgacaccgccacctattactgcactcgccgggactacgacgtgggc<br>tactactacttcgatttctggggacagggtgtcatggtgaccgtgtcctccggcggtggaggct<br>cagggggggcggctcggggaggggtggaagcggaggaggaggctccaagattgtgctg<br>acccagagccccactattaccgccgcctccccggggggaaaaggtcaccatcacttgtctggc<br>gtcctcacgcgtgtcgaatatctactggtatcagcagaagtccggcgccagccccaagctgct<br>gatctactcgacctcctccctcgcgtcgggagtgccttaccggttttctggctcgggaagcgga<br>accagctactccttgaccatcaacaccatggaagccgaggacgctgccacttactactgccac<br>cagtggtcgagcaaccccttggactttcggtggaggcaccaaactcgagctcaagggatcgca<br>ccaccatcaccatcatcatcac |
| CAR20-7 - Soluble scFv - aa | 839 | malpvtalllplalllhaarpqvtlkesgpgmlqpsktlsltcsfsgfslstsgmvvswirqps<br>gkslewlaaiawdgdkyynpslksrvtvskdtsntqvflritsvdiadtatyyctrrdydvgy<br>yyfdfwgqgvmvtvssggggsggggsggggsggggskivltqsptitaaspgekvtitcl<br>assrvsniywyqqksgaspkllijystsslasgvpyrfsgsgsgtsysltintmeaedaatyyc<br>hqwssnpwtfgggtklelkgshhhhhhhh |
| CAR20-7 Full - nt | 840 | atggccctccctgtcaccgccctgctgcttccgctggctcttctgctccacgccgctcggcccc<br>aagtcaccctgaaagaatcgggtcccggaatgctgcagccatccaagacgctgtcccttacat<br>gctcctctccggggttcagcctctcaacttccgggatggtggtgtcatggatcagacagccgag<br>cggaaagtccctggagtggctggcggccatcgcatgggatggcgataagtactacaaccog<br>agcctgaagtcaagggtcactgtgtccaaggacacctccaacacccaagtgttccttcggatc<br>acctccgtggacattgctgacaccgccacctattactgcactcgccgggactacgacgtgggc<br>tactactacttcgatttctggggacagggtgtcatggtgaccgtgtcctccggcggtggaggct<br>cagggggggcggctcggggaggggtggaagcggaggaggaggctccaagattgtgctg<br>acccagagccccactattaccgccgcctccccggggggaaaaggtcaccatcacttgtctggc<br>gtcctcacgcgtgtcgaatatctactggtatcagcagaagtccggcgccagccccaagctgct<br>gatctactcgacctcctccctcgcgtcgggagtgccttaccggttttctggctcgggaagcgga<br>accagctactccttgaccatcaacaccatggaagccgaggacgctgccacttactactgccac<br>cagtggtcgagcaaccccttggactttcggtggaggcaccaaactcgagctcaagaccactac<br>cccagcaccgaggccacccacccccggctcctaccatgcctcccagcctctgtccctgcgtc<br>cggaggcatgtagaccccgcagctggtggggccgtgcatacccgggtcttgacttcgcctgc<br>gatatctacatttgggcccctctggctggtactgcggggtcctgctgctttcactcgtgatcact<br>ctttactgtaagcgcggtcggaagaagctgctgtacatcttttaagcaaccccttcatgaggcctgt<br>gcagactactcaagaggaggacggctgttcatgccggttcccagaggaggaggaaggcgg<br>ctgcgaactgcgcgtgaaattcagccgcagcgacgctgcggcagatgctccagcctacaagcaggggcag<br>aaccagctctcaacgaactcaatcttggtcggagagaggagtacgacgtgctggacaagcg<br>gagaggacgggacccagaaatgggcgggaagccgcgcagaaagaatcccaagagggc<br>ctgtacaacgagctccaaaaggataagatggcagaagcctatagcgagattggtatgaaagg<br>ggaacgcagaagaggcaaaggccacgacggactgtaccagggactcagcaccgccacca<br>aggacacctatgacgctcttcacatgcaggccctgccgcctcgg |
| CAR20-7 Full - aa | 841 | malpvtalllplalllhaarpqvtlkesgpgmlqpsktlsltcsfsgfslstsgmvvswirqps<br>gkslewlaaiawdgdkyynpslksrvtvskdtsntqvflritsvdiadtatyyctrrdydvgy<br>yyfdfwgqgvmvtvssggggsggggsggggsggggskivltqsptitaaspgekvtitcl<br>assrvsniywyqqksgaspkllijystsslasgvpyrfsgsgsgtsysltintmeaedaatyyc<br>hqwssnpwtfgggtklelktttpaprpptpaptiasqplslrpeacrpaaggavhtrgldfac<br>diyiwaplagtcgvlllslvitlyckrgrkkllyifkqpfmrpvqttqeedgcscrfpeeeegg<br>celrvkfsrsadapaykqgqnqlynelnlgrreeydvldkrrgrdpemggkprrknpqeg<br>lynelqkdkmaeayseigmkgerrrgkghdglyqglstatkdtydalhmqalppr |
| CAR20-8 scFv domain | 842 | qiqlvqsgpelkkpgesvkiscckasgntvtgyamhwvrqapgkglkwmgwintysgk<br>ptyaddfkgrcvfsleasastahlqisnlknedtatyfcarstyygykdwfaywgqgtlvtv<br>ssggggsggggsggggsggggsniqltqspsrlsasvgdrvtlsckgsqninnylawyqq<br>klgeapkllijyntnnlqtgipsrfsgsgsgtdytftisglqpedvatyfccqynngntfgagtkl<br>elk |

TABLE 11A-continued

Rat CD20 CAR Constructs

| Name | SEQ ID NO: | Sequence |
|---|---|---|
| CAR20-8 scFv domain nt | 843 | caaattcagttggtgcagtccggcccggagctgaagaagcctggagaatccgtgaagatctc gtgcaaagcttccgggaacaccgtgaccggatacgcaatgcactgggtccgccaggcaccg ggaaagggactgaagtggatggggtggatcaacacctacagcggaaagccgacttacgcc gatgactttaagggacgctgtgtgttctccctggaagcgtccgcctcgactgcccatcttcaaat ctccaacctgaagaatgaggacaccgccacttacttctgcgcccggagcacctattacggcta caaggactggttcgcgtattgggccagggcactctcgtgaccgtgtcctccggcggtggag gctcagggggggcggctcggagggggtggaagcggaggaggaggctccaacatcca actgactcagagcccagccggctgtccgcctccgtggggacagggtcacactgagctgc aagggttctcagaacatcaacaactacctcgcgtggtaccagcagaagctgggagaggccc ccaagctgctcatctacaacaccaacaatctgcaaactggcattccatcgagattctcaggatc agggtccggtaccgactacaccttcacgatttcgggacttcagcctgaggatgtggccaccta cttctgctgtcagtacaacaacggcaacaccttcggtgctggcaccaagctggaactcaaa |
| CAR20-8 - Soluble scFv - nt | 844 | atggccctccctgtcaccgccctgctgcttccgctggctcttctgctccacgccgctcggcccc aaattcagttggtgcagtccggcccggagctgaagaagcctggagaatccgtgaagatctcgt gcaaagcttccgggaacaccgtgaccggatacgcaatgcactgggtccgccaggcaccgg gaaagggactgaagtggatggggtggatcaacacctacagcggaaagccgacttacgccga tgactttaagggacgctgtgtgttctccctggaagcgtccgcctcgactgcccatcttcaaatct ccaacctgaagaatgaggacaccgccacttacttctgcgcccggagcacctattacggctaca aggactggttcgcgtattgggccagggcactctcgtgaccgtgtcctccggcggtggaggc tcagggggggcggctcggagggggtggaagcggaggaggaggctccaacatcaact gactcagagcccagccggctgtccgcctccgtggggacagggtcacactgagctgcaag ggttctcagaacatcaacaactacctcgcgtggtaccagcagaagctgggagaggccccaa gctgctcatctacaacaccaacaatctgcaaactggcattccatcgagattctcaggatcaggg tccggtaccgactacaccttcacgatttcgggacttcagcctgaggatgtggccaccactcttctg ctgtcagtacaacaacggcaacaccttcggtgctggcaccaagctggaactcaaaggatcgc accaccatcaccatcatcac |
| CAR20-8 - Soluble scFv - aa | 845 | malpvtalllplalllhaarpqiqlvqsgpelkkpgesvkisckasgntvtgyamhwvrqa pgkglkwmgwintysgkptyaddfkgrcvfsleasastahlqisnlknedtatyfcarsty ygykdwfaywgqgtlvtvssggggsggggsggggsggggsniqltqspsrlsasvgdrvt lsckgsqninnylawyqqklgeapklliyntnnlqtgipsrfsgsgsgtdytftisglqpedv atyfccqynngntfgagtklelkgshhhhhhh |
| CAR20-8 - Full - nt | 846 | atggccctccctgtcaccgccctgctgcttccgctggctcttctgctccacgccgctcggcccc aaattcagttggtgcagtccggcccggagctgaagaagcctggagaatccgtgaagatctcgt gcaaagcttccgggaacaccgtgaccggatacgcaatgcactgggtccgccaggcaccgg gaaagggactgaagtggatggggtggatcaacacctacagcggaaagccgacttacgccga tgactttaagggacgctgtgtgttctccctggaagcgtccgcctcgactgcccatcttcaaatct ccaacctgaagaatgaggacaccgccacttacttctgcgcccggagcacctattacggctaca aggactggttcgcgtattgggccagggcactctcgtgaccgtgtcctccggcggtggaggc tcagggggggcggctcggagggggtggaagcggaggaggaggctccaacatcaact gactcagagcccagccggctgtccgcctccgtggggacagggtcacactgagctgcaag ggttctcagaacatcaacaactacctcgcgtggtaccagcagaagctgggagaggccccaa gctgctcatctacaacaccaacaatctgcaaactggcattccatcgagattctcaggatcaggg tccggtaccgactacaccttcacgatttcgggacttcagcctgaggatgtggccaccactcttctg ctgtcagtacaacaacggcaacaccttcggtgctggcaccaagctggaactcaaaaccacta ccccagcaccgaggccacccacccggctcctaccatcgcctcccagcctctgtccctgcgt ccggaggcatgtagacccgcagctggtgggccgtgcataccggggtcttgacttcgcctg cgatatctacatttgggcccctctggctggtacttgcggggtcctgctgctttcactcgtgatcac tctttactgtaagcgcggtcggaagaagctgctgtacatctttaagcaacccttcatgaggcctg tgcagactactcaagaggaggacggctgttcatgccggttccagaggaggaggaagggcg ctgcgaactgcgcgtgaaattcagccgcagcgcagatgctccagcctacaagcagggcag aaccagctctcaaacgaactcaatcttggtcggagagaggagtacgacgtgctggacaagcg gagaggacgggacccagaaatgggcgggaagccgcgcagaaagaatccccaagagggc ctgtacaacgagctccaaaaggataagatggcagaagcctatagcgagattggtatgaaagg ggaacgcagaagaggcaaaggccacgacgactgtaccagggactcagcaccgccacca aggacacctatgacgctcttcacatgcaggccctgccgcctcgg |
| CAR20-8 - Full - aa | 847 | malpvtalllplalllhaarpqiqlvqsgpelkkpgesvkisckasgntvtgyamhwvrqa pgkglkwmgwintysgkptyaddfkgrcvfsleasastahlqisnlknedtatyfcarsty ygykdwfaywgqgtlvtvssggggsggggsggggsggggsniqltqspsrlsasvgdrvt lsckgsqninnylawyqqklgeapklliyntnnlqtgipsrfsgsgsgtdytftisglqpedv atyfccqynngntfgagtklelktttpaprpptpaptiasqplslrpeacrpaaggavhtrgld facdiyiwaplagtcgvlllslvitlyckrgrkkllyifkqpfmrpvqttqeedgcscrfpeee ggcelrvkfsrsadapaykqgqnqlynelnlgrreeydvldkrrgrdpemggkprrknp qeglynelqkdkmaeayseigmkgerrrgkhdglyqglstatkdtydalhmqalppr |
| CAR20-9 scFv domain | 848 | divmtqtpssqavsagekvtmsckssqsllysenkknylawyqqkpgqspkllifwastr esgvpdrfigsgsgtdftltissvqaedlavyycqqyynfptfgsgtkleikggggsggggs ggggsggggsevqlvesgglvqpgrslklscaasgftfrdyymawvrqapkkglewva sisyegnpyygdsvkgrftisrnnakstlylqmnslrsedtatyycarhdhnnvdwfayw gqgtlvtvss |

TABLE 11A-continued

Rat CD20 CAR Constructs

| Name | SEQ ID NO: | Sequence |
|---|---|---|
| CAR20-9 scFv domain nt | 849 | gacatcgtgatgactcagactccaagcagccaggccgtgtccgccggagagaaagtcacca tgtcgtgcaagagctcccagtccctgctgtactccgaaaacaagaagaattatctcgcctggta ccagcagaagcctggacagtccccgaagcctcctgatcttttgggcgtcgaccagggaatcc ggcgtgcccgatcgcttcattggctccggttccggcaccgacttcaccctgaccattagcagcgt ccaggcggaggacctggctgtgtactactgccaacagtactacaacttcccccacttcggatcg gggaccaagctggagatcaagggcggtggaggctcagggggggcggctcggggaggg gtggaagcggaggaggaggctccgaagtgcagcttgtggagtctggcggcggtctggtgca gccgggaagatccctgaagctgtcatgcgccgcgtccgggtttaccttccgcgattactacatg gcctgggtcagacaggcacctaagaaggggctggaatgggtggcatccatctcatatgaagg aaacccgtactacgagactcggtgaaaggccgcttcactatctcacggaacaacgctaaga gcacgctgtacttgcaaatgaactcctccggtcggaggacacagccacttactactgtgccc ggcacgaccataacaacgtcgattggttcgcctactggggtcaaggaaccctcgtgaccgtgt cctcc |
| CAR20-9 - Soluble scFv - nt | 850 | atggccctccctgtcaccgccctgctgcttccgctggctcttctgctccacgccgctcggcccg acatcgtgatgactcagactccaagcagccaggccgtgtccgccggagagaaagtcaccat gtcgtgcaagagctcccagtccctgctgtactccgaaaacaagaagaattatctcgcctggtac cagcagaagcctggacagtccccgaagcctcctgatcttttgggcgtcgaccagggaatccgg cgtgcccgatcgcttcattggctccggttccggcaccgacttcaccctgaccattagcagcgtc caggcggaggacctggctgtgtactactgccaacagtactacaacttcccccacttcggatcg gggaccaagctggagatcaagggcggtggaggctcagggggggcggctcggggaggg gtggaagcggaggaggaggctccgaagtgcagcttgtggagtctggcggcggtctggtgca gccgggaagatccctgaagctgtcatgcgccgcgtccgggtttaccttccgcgattactacatg gcctgggtcagacaggcacctaagaaggggctggaatgggtggcatccatctcatatgaagg aaacccgtactacgagactcggtgaaaggccgcttcactatctcacggaacaacgctaaga gcacgctgtacttgcaaatgaactcctccggtcggaggacacagccacttactactgtgccc ggcacgaccataacaacgtcgattggttcgcctactggggtcaaggaaccctcgtgaccgtgt cctccggatcgcaccaccatcaccatcatcac |
| CAR20-9 - Soluble scFv - aa | 851 | malpvtalllplalllhaarpdivmtqtpssqavsagekvtmsckssqsllysenkknylaw yqqkpgqspkllifwastresgvpdrfigsgsgtdftltissvqaedlavyycqqyynfptfg sgtkleikggggsggggsggggsggggsevqlvesgggglvqpgrslklscaasgftfrdyy mawvrqapkkglewvasisyegnpyygdsvkgrftisrnnakstlylqmnslrsedtaty ycarhdhnnvdwfaywgqgtlvtvssgshhhhhhhh |
| CAR20-9 - Full - nt | 852 | atggccctccctgtcaccgccctgctgcttccgctggctcttctgctccacgccgctcggcccg acatcgtgatgactcagactccaagcagccaggccgtgtccgccggagagaaagtcaccat gtcgtgcaagagctcccagtccctgctgtactccgaaaacaagaagaattatctcgcctggtac cagcagaagcctggacagtccccgaagcctcctgatcttttgggcgtcgaccagggaatccgg cgtgcccgatcgcttcattggctccggttccggcaccgacttcaccctgaccattagcagcgtc caggcggaggacctggctgtgtactactgccaacagtactacaacttcccccacttcggatcg gggaccaagctggagatcaagggcggtggaggctcagggggggcggctcggggaggg gtggaagcggaggaggaggctccgaagtgcagcttgtggagtctggcggcggtctggtgca gccgggaagatccctgaagctgtcatgcgccgcgtccgggtttaccttccgcgattactacatg gcctgggtcagacaggcacctaagaaggggctggaatgggtggcatccatctcatatgaagg aaacccgtactacgagactcggtgaaaggccgcttcactatctcacggaacaacgctaaga gcacgctgtacttgcaaatgaactcctccggtcggaggacacagccacttactactgtgccc ggcacgaccataacaacgtcgattggttcgcctactggggtcaaggaaccctcgtgaccgtgt cctccaccactaccccagcaccgaggcacccaccccggctcctaccatcgcctcccagcct ctgtccctgcgtccggaggcatgtagacccgcagctggtggggccgtgcataccgggtgtct tgacttcgcctgcgatatctacatttgggcccctctggctggtacttgcggggtcctgctgctttc actcgtgatcactcttactgtaagcgcggtcggaagaagctgctgtacatcttttaagcaaccctt catgaggcctgtgcagactactcaagaggaggacggctgttcatgccggttcccagaggagg aggaaggcggctgcgaactgcgcgtgaaattcagccgcagcgccagatgctccagcctacaa gcaggggcagaaccagctctacaacgaactcaatcttggtcggagagaggagtacgacgtg ctggacaagcggagaggacgggacccagaaatgggcgggaagccgcgcagaaagaatc cccaagagggcctgtacaacgagctccaaaaggataagatggcagaagcctatagcgagat tggtatgaaaggggaacgcagaagaggcaaaggccacgacggactgtaccagggactcag caccgccaccaaggacacctatgacgctcttcacatgcaggccctgccgcctcgg |
| CAR20-9 - Full - aa | 853 | malpvtalllplalllhaarpdivmtqtpssqavsagekvtmsckssqsllysenkknylaw yqqkpgqspkllifwastresgvpdrfigsgsgtdftltissvqaedlavyycqqyynfptfg sgtkleikggggsggggsggggsggggsevqlvesgggglvqpgrslklscaasgftfrdyy mawvrqapkkglewvasisyegnpyygdsvkgrftisrnnakstlylqmnslrsedtaty ycarhdhnnvdwfaywgqgtlvtvssttpapprpptpaptiasqplslrpeacrpaaggav htrgldfacdiyiwaplagtcgvlllslvitlyckrgrkkllyifkqpfmrpvqttqeedgcscr fpeeeeggcelrvkfsrsadapaykqgqnqlynelnlgrreeydvldkrrgrdpemggkp rrknpqeglynelqkdkmaeayseigmkgerrrgkghdglyqglstatkdtydalhmqa lppr |
| CAR20-10 scFv domain | 854 | diqmtqsppslsaslgdkvtitcqasqninkyiawyqqkpgkaprlliirytstlesgtpsrfsg sgsgrdysfsisnvesgdvasyyclqyddlpytfgpgtklelkggggsggggsggggsgg ggsevqlvesgggglvqpgtslklscvasgftfsssgmqwirqapkkglewisgiyydsyk ksyadsvkgrftisrdnskntlylemnslrsedtatyycaksayygykdyfdywgqgvm vtvss |

TABLE 11A-continued

Rat CD20 CAR Constructs

| Name | SEQ ID NO: | Sequence |
|---|---|---|
| CAR20-10 scFv domain nt | 855 | gacatccaaatgacacagtcacccccttctctttccgcgagcctgggagataaggtcaccatta cgtgccaagcgtcccagaacatcaacaagtacatcgcctggtaccagcagaaaccgggaaa ggccccgcggctgctgattagatacacctcgactctggaatccggcactccatcaagattcag cggctccggcagcggggggactactcgttctccatctccaatgtggagtccggggacgtgg ccagctactattgcctgcaatacgacgatctgccctacaccttcggacctggaaccaagctgg aactcaagggcggtggaggctcagggggggcggctcggaggggtggaagcggagg aggaggctccgaggtccagcttgtggaatcaggaggcggactcgtccagccgggtactagc ctgaagctcagctgtgtggccagcggttttaccttctcgtcctccgggatgcagtggattcggc aggctcccaagaagggactggaatggatctcgggcatctactacgactcgtacaagaagtcct acgccgattccgtgaaaggtcgcttcaccatctcccgggacaacagcaagaacactctgtacc tcgagatgaactccttgcgctccgaggataccgcaacctattactgcgccaagtcggcctacta cggctacaaggactacttcgactattggggccagggagtgatggtgaccgtgtcctcc |
| CAR20-10 - Soluble scFv - nt | 856 | atggccctccctgtcaccgccctgctgcttccgctggctcttctgctccacgccgctcggcccg acatccaaatgacacagtcacccccttctctttccgcgagcctgggagataaggtcaccattac gtgccaagcgtcccagaacatcaacaagtacatcgcctggtaccagcagaaaccgggaaag gccccgcggctgctgattagatacacctcgactctggaatccggcactccatcaagattcagc ggctccggcagcggggggactactcgttctccatctccaatgtggagtccggggacgtggc cagctactattgcctgcaatacgacgatctgccctacaccttcggacctggaaccaagctgga actcaagggcggtggaggctcagggggggcggctcggaggggtggaagcggagga ggaggctccgaggtccagcttgtggaatcaggaggcggactcgtccagccgggtactagcc tgaagctcagctgtgtggccagcggttttaccttctcgtcctccgggatgcagtggattcggca ggctcccaagaagggactggaatggatctcgggcatctactacgactcgtacaagaagtccta cgccgattccgtgaaaggtcgcttcaccatctcccgggacaacagcaagaacactctgtacct cgagatgaactccttgcgctccgaggataccgcaacctattactgcgccaagtcggcctacta cggctacaaggactacttcgactattggggccagggagtgatggtgaccgtgtcctccggatc gcaccaccatcaccatcatcac |
| CAR20-10 - Soluble scFv - aa | 857 | malpvtallllplalllhaarpdiqmtqsppslsaslgdkvtitcqasqninkyiawyqqkpg kaprlliryts tlesgtpsrfsgsgsgrdysfsisnvesgdvasyyclqyddlpytfgpgtklel kggggsggggsggggsggggsevqlvesgglvqpgtslklscvasgftfsssgmqwir qapkkglewisgiyydsykksyadsvkgrftisrdnskntlylemnslrsedtatyycaksa yygykdyfdywgqgvmvtvssgshhhhhhhh |
| 194181 CAR20-10 - Full - nt | 858 | atggccctccctgtcaccgccctgctgcttccgctggctcttctgctccacgccgctcggcccg acatccaaatgacacagtcacccccttctctttccgcgagcctgggagataaggtcaccattac gtgccaagcgtcccagaacatcaacaagtacatcgcctggtaccagcagaaaccgggaaag gccccgcggctgctgattagatacacctcgactctggaatccggcactccatcaagattcagc ggctccggcagcggggggactactcgttctccatctccaatgtggagtccggggacgtggc cagctactattgcctgcaatacgacgatctgccctacaccttcggacctggaaccaagctgga actcaagggcggtggaggctcagggggggcggctcggaggggtggaagcggagga ggaggctccgaggtccagcttgtggaatcaggaggcggactcgtccagccgggtactagcc tgaagctcagctgtgtggccagcggttttaccttctcgtcctccgggatgcagtggattcggca ggctcccaagaagggactggaatggatctcgggcatctactacgactcgtacaagaagtccta cgccgattccgtgaaaggtcgcttcaccatctcccgggacaacagcaagaacactctgtacct cgagatgaactccttgcgctccgaggataccgcaacctattactgcgccaagtcggcctacta cggctacaaggactacttcgactattggggccagggagtgatggtgaccgtgtcctccaccac tacccagcaccgaggccacccaccccggctcctaccatcgcctccagcctctgtccctgc gtccggaggcatgtagacccgcagctggtggggccgtgcataccgggtcttgacttctgcc tgcgatatctacatttgggcccctctggctggtacttgcggggtcctgctgctttcactcgtgatc actctttactgtaagcgcggtcggaagaagctgctgtacatcttaagcaacccttcatgaggcc tgtgcagactactcaagaggaggacggctgttcatgccggttcccagaggaggaggaagc ggctgcgaactgcgcgtgaaattcagccgcagcgacgatgcctccagcctacaagcagggc agaaccagctctacaacgaactcaatcttggtcggagagaggagtacgacgtgctggacaag cggagaggacgggacccagaaatgggcgggaagccgcgcagaaagaatcccaagagg gcctgtacaacgagctccaaaaggataagatggcagaagcctatagcgagattggtatgaaa ggggaacgcagaagaggcaaaggccacgacggactgtaccagggactcagcaccgccac caaggacacctatgacgctcttcacatgcaggccctgccgcctcgg |
| 194181 CAR20-10 - Full - aa | 859 | malpvtallllplalllhaarpdiqmtqsppslsaslgdkvtitcqasqninkyiawyqqkpg kaprlliryts tlesgtpsrfsgsgsgrdysfsisnvesgdvasyyclqyddlpytfgpgtklel kggggsggggsggggsggggsevqlvesgglvqpgtslklscvasgftfsssgmqwir qapkkglewisgiyydsykksyadsvkgrftisrdnskntlylemnslrsedtatyycaksa yygykdyfdywgqgvmvtvsstttpaprpptpaptiasqplslrpeacrpaaggavhtrgl dfacdiyiwaplagtcgvlllslvitlyckrgrkkllyifkqpfmrpvqttqeedgcscrfpee eeggcelrvkfsrsadapaykqgqnqlynelnlgrreeydvldkrrgrdpemggkprrkn pqeglynelqkdkmaeayseigmkgerrrgkhdglyqglstatkdtydalhmqalppr |
| CAR20-11 scFv domain | 860 | divmtqtpssqavsagekvtmsckssqsllysenkknylawyqqkpgqspkllliywastr esgvpdrfigsgsgtdftltissvqaedlavyycqqyynfppwtfgggtklelkggggsggg gsggggsggggsqiqlvqsgpelkkpgesvkiscktseytftdyafhwvkqapgkglkw mgwintysgkptyaddfkgrfvfsledsartanlqisnlknedtatyfcargayygyrdwft ywgqgtlvtvss |

TABLE 11A-continued

Rat CD20 CAR Constructs

| Name | SEQ ID NO: | Sequence |
| --- | --- | --- |
| CAR20-11 scFv domain nt | 861 | gatattgtgatgacccagacccgtcgagccaggcagtgtccgctggagaaaaggtcaccat gtcctgcaagagctcacagtccctgttgtactccgaaaacaagaagaattacctggcctggtac cagcagaagcccggacagtcccctaaactgctgatctactgggcctcgactagggaatctgg cgtgcccgaccgctttatcggaagcggttcagggactgacttcaccctgaccattagcagcgt gcaggccgaggacctggcggtgtactactgtcaacagtactacaacttcccgccctggactttt cggcggtggaacgaagctcgaactcaagggcggtggaggctcagggggggcggtcggg aggggggtggaagcggaggaggaggctcccaaattcaactggtccagtccggccctgagct gaagaagccgggagaatccgtgaagatctcctgcaagacctcggagtacaccttcactgact acgccttccactgggtcaagcaggcacctgggaaaggcctgaagtggatgggctggatcaa cacttactcggggaagccaacctacgccgatgatttcaagggaagattcgtgtttagcctggag gactccgcccggacagctaacctccaaatctccaaccttaagaacgaggacactgcgaccta cttctgcgcgcgggggagcctattacggttatcgcgactggttcacctactggggacagggcac cctcgtgaccgtgtcctcc |
| CAR20-11 - Soluble scFv - nt | 862 | atggcccctcctgtcaccgccctgctgcttccgctggctcttctgctccacgccgctcggcccg atattgtgatgacccagacccgtcgagccaggcagtgtccgctggagaaaaggtcaccatg tcctgcaagagctcacagtccctgttgtactccgaaaacaagaagaattacctggcctggtacc agcagaagcccggacagtcccctaaactgctgatctactgggcctcgactagggaatctggc gtgcccgaccgctttatcggaagcggttcagggactgacttcaccctgaccattagcagcgtg caggccgaggacctggcggtgtactactgtcaacagtactacaacttcccgccctggactttc ggcggtggaacgaagctcgaactcaagggcggtggaggctcagggggggcggtcggg aggggggtggaagcggaggaggaggctcccaaattcaactggtccagtccggccctgagctg aagaagccgggagaatccgtgaagatctcctgcaagacctcggagtacaccttcactgacta cgccttccactgggtcaagcaggcacctgggaaaggcctgaagtggatgggctggatcaac acttactcggggaagccaacctacgccgatgatttcaagggaagattcgtgtttagcctggag gactccgcccggacagctaacctccaaatctccaaccttaagaacgaggacactgcgaccta cttctgcgcgcgggggagcctattacggttatcgcgactggttcacctactggggacagggcac cctcgtgaccgtgtcctccggatcgcaccaccatcaccatcatcac |
| CAR20-11 - Soluble scFv - aa | 863 | malpvtalllplallllhaarpdivmtqtpssqavsagekvtmsckssqsllysenkknylaw yqqkpgqspklliywastresgvpdrfigsgsgtdftltissvqaedlavyycqqyynfpp wtfgggtklelkggggsggggsggggsggggsqiqlvqsgpelkkpgesvkiscktseyt ftdyafhwvkqapgkglkwmgwintysgkptyaddfkgrfvfsledsartanlqisnlkn edtatyfcargayygyrdwftywgqgtlvtvssgshhhhhhhh |
| CAR20-11 - Full - nt | 864 | atggcccctcctgtcaccgccctgctgcttccgctggctcttctgctccacgccgctcggcccg atattgtgatgacccagacccgtcgagccaggcagtgtccgctggagaaaaggtcaccatg tcctgcaagagctcacagtccctgttgtactccgaaaacaagaagaattacctggcctggtacc agcagaagcccggacagtcccctaaactgctgatctactgggcctcgactagggaatctggc gtgcccgaccgctttatcggaagcggttcagggactgacttcaccctgaccattagcagcgtg caggccgaggacctggcggtgtactactgtcaacagtactacaacttcccgccctggactttc ggcggtggaacgaagctcgaactcaagggcggtggaggctcagggggggcggtcggg aggggggtggaagcggaggaggaggctcccaaattcaactggtccagtccggccctgagctg aagaagccgggagaatccgtgaagatctcctgcaagacctcggagtacaccttcactgacta cgccttccactgggtcaagcaggcacctgggaaaggcctgaagtggatgggctggatcaac acttactcggggaagccaacctacgccgatgatttcaagggaagattcgtgtttagcctggag gactccgcccggacagctaacctccaaatctccaaccttaagaacgaggacactgcgaccta cttctgcgcgcgggggagcctattacggttatcgcgactggttcacctactggggacagggcac cctcgtgaccgtgtcctccaccactacccgcaccgaggccaccccggctcctccacca tcgcctcccagcctctgtccctcgcgtccggaggcatgtagacccgcagctggtggggccgtg cataccgggggtcttgacttcgcctgcgatatctacatttgggccctctggctggtacttgcgg ggtcctgctgctttcactcgtgatcactcttttactgtaagcgcggtcggaagaagctgctgtacat ctttaagcaaccttcatgaggcctgtgcagactactcaagaggaggacggctgttcatgccg gttcccagaggaggaggaaggcggctgcgaactgcgcgtgaaattcagccgcagcgcaga tgctccagcctacaagcaggggcagaaccagctctacaacgaactcaatcttggtcggagag aggagtacgacgtgctggacaagcggagaggacgggacccagaaatgggcgggaagcc gcgcagaaagaatcccaagagggcctgtacaacgagctccaaaaggataagatggcaga agcctatagcgagattggtatgaagggggaacgcagaagaggcaaaggccacgacggact gtaccggggactcagcaccgccaccaaggacacctatgacgctcttcacatgcaggccctgc cgcctcgg |
| CAR20-11 - Full - aa | 865 | malpvtalllplallllhaarpdivmtqtpssqavsagekvtmsckssqsllysenkknylaw yqqkpgqspklliywastresgvpdrfigsgsgtdftltissvqaedlavyycqqyynfpp wtfgggtklelkggggsggggsggggsggggsqiqlvqsgpelkkpgesvkiscktseyt ftdyafhwvkqapgkglkwmgwintysgkptyaddfkgrfvfsledsartanlqisnlkn edtatyfcargayygyrdwftywgqgtlvtvsstttpaprpptpaptiasqplslrpeacrpa aggavhtrgldfacdiyiwaplagtcgvlllslvitlyckrgrkkllyifkqpfmrpvqttqee dgcscrfpeeeeggcelrvkfsrsadapaykqgqnqlynelnlgrreeydvldkrrgrdpe mggkpprrknpqeglynelqkdkmaeayseigmkgerrrgkghdglyqglstatkdtyd alhmqalppr |
| CAR20-12 scFv domain | 866 | qvvltqpksvstslestvklsckinsgnigsyfihwyqqhegrspttmiyrddkrphgvpdr fsgsidsssnsafltinnvqtedeaiyfchsydsginivfgggtkltvlggggsggggsgggg sggggsevqlvesgglvqpgrslklsclasgftfskygmnwirqapgkglewvasissts iyyyyadtvkgrftisrenakntlylqmtslrsedtalyycarhdyssysywgqgvmvtvss |

TABLE 11A-continued

Rat CD20 CAR Constructs

| Name | SEQ ID NO: | Sequence |
|---|---|---|
| CAR20-12 scFv domain nt | 867 | caagtcgtgctgacgcaacccaagtccgtgagcaccagcctggagagcaccgtgaagctca gctgcaagattaactcgggcaacattgggtcctacttcatccattggtaccagcagcacgaag gacggtccctaccactatgatctaccgggacgacaagcggccgcacggagtgccggaca gattctcggttcaatcgattcctcatctaactcggcgtttctcaccatcaacaacgtgcagacc gaggacgaagcgatctacttctgccactcctacgactcgggtattaacattgtgttcggcggcg ggactaagctgacagtgctgggcggtggaggctcaggggggggcggctcggaggggt ggaagcggaggaggaggctccgaggtgcagctcgtcgaatccggtggaggactggtgcag ccaggaagatccctgaagctgtcctgtctcgcctcgggcttcactttctccaaatacggcatga attggattcgccaggcacccggaaaggggctggaatgggtggccagcatcagctcgactag catctacatctactatgccgataccgtcaagggccgcttcactatctcccgcgagaacgctaag aacacccttacttgcaaatgacctccctgaggtccgaagataccgccctgtactattgcgccc ggcacgactactcatcctactcctactgggacagggagtcatggtgaccgtgtcctcc |
| CAR20-12 - Soluble scFv - nt | 868 | atggccctccctgtcaccgccctgctgcttccgctggctcttctgctccacgccgctcggcccc aagtcgtgctgacgcaacccaagtccgtgagcaccagcctggagagcaccgtgaagctcag ctgcaagattaactcgggcaacattgggtcctacttcatccattggtaccagcagcacgaagga cggtccctaccactatgatctaccgggacgacaagcggccgcacggagtgccggacagat tctcggttcaatcgattcctcatctaactcggcgtttctcaccatcaacaacgtgcagaccgag gacgaagcgatctacttctgccactcctacgactcgggtattaacattgtgttcggcggcggga ctaagctgacagtgctgggcggtggaggctcagggggggcggctcggagggggtgga agcggaggaggaggctccgaggtgcagctcgtcgaatccggtggaggactggtgcagcca ggaagatccctgaagctgtcctgtctcgcctcgggcttcactttctccaaatacggcatgaattg gattcgccaggcacccggaaaggggctggaatgggtggccagcatcagctcgactagcatc tacatctactatgccgataccgtcaagggccgcttcactatctcccgcgagaacgctaagaaca cccttacttgcaaatgacctccctgaggtccgaagataccgccctgtactattgcgcccggca cgactactcatcctactcctactgggacagggagtcatggtgaccgtgtcctccggatcgca ccaccatcaccatcatcatcac |
| CAR20-12 - Soluble scFv - aa | 869 | malpvtalllplalllhaarpqvvltqpksvstslestvklsckinsgnigsyfihwyqqhegr spttmiyrddkrphgvpdrfsgsidsssnsafltinnvqtedeaiyfchsydsginivfggt kltvlgggsgggsgggsggggsevqlvesgglvqpgrslklsclasgftfskygmn wirqapgkglewvasisstsiyiyyadtvkgrftisrenakntlylqmtslrsedtalyycarh dyssysywgqgvmvtvssgshhhhhhhh |
| CAR20-12 - Full - nt | 870 | atggccctccctgtcaccgccctgctgcttccgctggctcttctgctccacgccgctcggcccc aagtcgtgctgacgcaacccaagtccgtgagcaccagcctggagagcaccgtgaagctcag ctgcaagattaactcgggcaacattgggtcctacttcatccattggtaccagcagcacgaagga cggtccctaccactatgatctaccgggacgacaagcggccgcacggagtgccggacagat tctcggttcaatcgattcctcatctaactcggcgtttctcaccatcaacaacgtgcagaccgag gacgaagcgatctacttctgccactcctacgactcgggtattaacattgtgttcggcggcggga ctaagctgacagtgctgggcggtggaggctcaggggggggcggctcggagggggt gga agcggaggaggaggctccgaggtgcagctcgtcgaatccggtggaggactggtgcagcca ggaagatccctgaagctgtcctgtctcgcctcgggcttcactttctccaaatacggcatgaattg gattcgccaggcacccggaaaggggctggaatgggtggccagcatcagctcgactagcatc tacatctactatgccgataccgtcaagggccgcttcactatctcccgcgagaacgctaagaaca cccttacttgcaaatgacctccctgaggtccgaagataccgccctgtactattgcgcccggca cgactactcatcctactcctactgggacagggagtcatggtgaccgtgtcctccaccactacc ccagcaccgaggccacccaccccggctcctaccatcgcctcccagcctctgtccctgcgtcc ggaggcatgtagacccgcagctggtggggccgtgcatacccggggtcttgacttcgcctgcg atatctacatttgggcccctctggctggtacttgcggggtcctgctgcttttcactcgtgatcactct ttactgtaagcgcggtcggaagaagctgctgtacatctttaagcaacccttcatgaggcctgtg cagactactcaagaggaggacggctgttcatgccggttcccagaggaggaggaaggcggct gcgaactgcgcgtgaaattcagccgcagcgcagatgctccagcctacaagcaggggcaga accagctctacaacgaactcaatcttggtcggagagaggagtacgacgtgctggacaagcgg agaggacgggacccagaaatgggcgggaagccgcgcagaaagaatccccaagagggcct gtacaacgagctccaaaaggataagatggcagaagcctatagcgagattggtatgaagggg aacgcagaagaggcaaaggccacgacggactgtaccagggactcagcaccgccaccaa ggacacctatgacgctcttcacatgcaggccctgccgcctcgg |
| CAR20-12 - Full - aa | 871 | malpvtalllplalllhaarpqvvltqpksvstslestvklsckinsgnigsyfihwyqqhegr spttmiyrddkrphgvpdrfsgsidsssnsafltinnvqtedeaiyfchsydsginivfggt kltvlgggsgggsgggsggggsevqlvesgglvqpgrslklsclasgftfskygmn wirqapgkglewvasisstsiyiyyadtvkgrftisrenakntlylqmtslrsedtalyycarh dyssysywgqgvmvtvssttttpaprpptpaptiasqplslrpeacrpaaggavhtrgldfac diyiwaplagtcgvlllslvitlyckrgrkkllyifkqpfmrpvqtteedgcscrfpeeeegg celrvkfsrsadapaykqgqnqlynelnlgrreeydvldkrrgrdpemggkprrknpqeg lynelqkdkmaeayseigmkgerrrgkghdglyqglstatkdtydalhmqalppr |
| CAR20-13 scFv domain | 872 | dvqmtqspsllsasvgdavtinckasqninryhlnwyqqklgegprlliysanslqtgipsrfs gsgsgadftltitspqpedvatyfclqhnswpltfgsgtkleikgggsggggsggggsggg gsqvtlkesgpgilqpsqtlsltctftrfslstygmsvgwirqpsgkglewladiwwdddkh ynpslknrltiskdtsknqaflkitnvdtadtatyycarssttdgivtyvmdvwgqgasvtvss |

TABLE 11A-continued

Rat CD20 CAR Constructs

| Name | SEQ ID NO: | Sequence |
|---|---|---|
| CAR20-13 scFv domain nt | 873 | gacgtgcagatgactcagtccccgtcgctcctgtccgcctccgtcggcgacgccgtgactatt aactgcaaggcgtcccagaacatcaatcggtacctgaactggtaccagcaaaaactgggaga agggccgagacttctcatctactccgccaactccctgcaaactggcatcccgtcgaggttcag cggatcaggctctggtgccgacttcactttgaccatcacgagccctcagcccgaagatgtggc cacctacttctgcctccaacacaactcctggcccctgacctttggttcgggcaccaagctggag atcaagggcggtggaggctcagggggggcggctcgggaggggtggaagcggaggag gaggctcccaagtcacgctgaaggaatcgggccctggaattctgcagccaagccagaccct ctcgcttacttgcaccttcacccgcttctcactgtccacttacggaatgtccgtgggatggattcg gcagcccagcggaaagggtttggagtggctggccgacatttggtgggatgacgacaagcatt acaacctagcctgaagaatcggctcaccatcagcaaagacacctccaagaaccaggcgttc ctgaagatcaccaacgtggataccgccgacactgcaacatactattgtgcccgctcctcaacc accgatgggatcgtgacctacgtgatggacgtctggggccagggagcttccgtgaccgtgtc ctcc |
| CAR20-13 - Soluble scFv - nt | 874 | atggccctccctgtcaccgccctgctgcttccgctggctcttctgctccacgccgctcggcccg acgtgcagatgactcagtccccgtcgctcctgtccgcctccgtcggcgacgccgtgactatta actgcaaggcgtcccagaacatcaatcggtacctgaactggtaccagcaaaaactgggagaa gggccgagacttctcatctactccgccaactccctgcaaactggcatcccgtcgaggttcagc ggatcaggctctggtgccgacttcactttgaccatcacgagccctcagcccgaagatgtggcc acctacttctgcctccaacacaactcctggcccctgacctttggttcgggcaccaagctggaga tcaagggcggtggaggctcagggggggcggctcgggaggggtggaagcggaggagg aggctcccaagtcacgctgaaggaatcgggccctggaattctgcagccaagccagaccctct cgcttacttgcaccttcacccgcttctcactgtccacttacggaatgtccgtgggatggattcg cagcccagcggaaagggtttggagtggctggccgacatttggtgggatgacgacaagcatta caaccctagcctgaagaatcggctcaccatcagcaaagacacctccaagaaccaggcgttcc tgaagatcaccaacgtggataccgccgacactgcaacatactattgtgcccgctcctcaacca ccgatgggatcgtgacctacgtgatggacgtctggggccagggagcttccgtgaccgtgtcct ccggatcgcaccaccatcaccatcatcac |
| CAR20-13 - Soluble scFv - aa | 875 | malpvtalllplalllhaarpdvqmtqspsllsasvgdavtinckasqninrylnwyqqklg egprlliysanslqtgipsrfsgsgsgadftltitspqpedvatyfclqhnswpltfgsgtkleik ggggsggggsggggsggggsqvtlkesgpgilqpsqtlsltctfftrfslstygmsvgwirqp sgkglewladiwwdddkhynpslknrltiskdtsknqaflkitnvdtadtatyycarssttd givtyvmdvwgqgasvtvssgshhhhhhhh |
| CAR20-13 - Full nt | 876 | atggccctccctgtcaccgccctgctgcttccgctggctcttctgctccacgccgctcggcccg acgtgcagatgactcagtccccgtcgctcctgtccgcctccgtcggcgacgccgtgactatta actgcaaggcgtcccagaacatcaatcggtacctgaactggtaccagcaaaaactgggagaa gggccgagacttctcatctactccgccaactccctgcaaactggcatcccgtcgaggttcagc ggatcaggctctggtgccgacttcactttgaccatcacgagccctcagcccgaagatgtggcc acctacttctgcctccaacacaactcctggcccctgacctttggttcgggcaccaagctggaga tcaagggcggtggaggctcagggggggcggctcgggaggggtggaagcggaggagg aggctcccaagtcacgctgaaggaatcgggccctggaattctgcagccaagccagaccctct cgcttacttgcaccttcacccgcttctcactgtccacttacggaatgtccgtgggatggattcg cagcccagcggaaagggtttggagtggctggccgacatttggtgggatgacgacaagcatta caaccctagcctgaagaatcggctcaccatcagcaaagacacctccaagaaccaggcgttcc tgaagatcaccaacgtggataccgccgacactgcaacatactattgtgcccgctcctcaacca ccgatgggatcgtgacctacgtgatggacgtctggggccagggagcttccgtgaccgtgtcct ccaccactacccagcaccgaggccaccacccccggctcctaccatcgcctcccagcctctg tccctgcgtccggaggcatgtagacccgcagctggtggggccgtgcataccgggtcttga cttcgcctgcgatatctacatttgggcccctctggctggtacttgcggggtcctgctgctttcact cgtgatcactctttactgtaagcgcggtcggaagaagctgctgtacatcttttaagcaaccctttcat gaggcctgtgcagactactcaagaggaggacggctgttcatgccggttcccagaggaggag gaaggcggctgcgaactgcgcgtgaaattcagccgcagcgcagatgctccagcctacaagc aggggcagaaccagctctacaacgaactcaatcttggtcggagagaggagtacgacgtgct ggacaagcggagaggacgggacccagaaatgggcgggaagccgcgcagaaagaatccc caagagggcctgtacaacgagctccaaaaggataagatgcagaagcctatagcggagattg gtatgaaaggggaacgcagaagaggcaaaggccacgacggactgtaccagggactcagc accgccaccaaggacacctatgacgctcttcacatgcaggccctgccgcctcgg |
| CAR20-13 - Full aa | 877 | malpvtalllplalllhaarpdvqmtqspsllsasvgdavtinckasqninrylnwyqqklg egprlliysanslqtgipsrfsgsgsgadftltitspqpedvatyfclqhnswpltfgsgtkleik ggggsggggsggggsggggsqvtlkesgpgilqpsqtlsltctfftrfslstygmsvgwirqp sgkglewladiwwdddkhynpslknrltiskdtsknqaflkitnvdtadtatyycarssttd givtyvmdvwgqgasvtvsstttpaprpptpaptiasqplslrpeacrpaaggavhtrgldf acdiyiwaplagtcgvlllslvitlyckrgrkkllyifkqpfmrpvqttqeedgcscrfpeeee ggcelrvkfsrsadapaykqgqnqlynelnlgrreeydvldkrrgrdpemggkprrknpq eglynelqkdkmaeayseigmkgerrrgkghdglyqglstatkdtydalhmqalppr |
| CAR20-14 scFv domain | 878 | diqmtqspsflsasvgdrvtinckasqninrylnwyqqklgeapkllliynanslqtgipsrfs gsgsgtdftltisslqpadvatyfclqhnsrpltfgsgtileikggggsggggsggggsggggs qvtlkesgpgllqpsqtlsltctfagfslnthgmgvgwirqpsgkglewlaniwwdddky ynpslknrltmskdtsnnqaflkitnvdtadtatyycariegspvvttvfdywgqgvmvtv ss |

TABLE 11A-continued

Rat CD20 CAR Constructs

| Name | SEQ ID NO: | Sequence |
|---|---|---|
| CAR20-14 scFv domain nt | 879 | gacatccaaatgacccagtcacctagctttctgtcggcctcggtcggcgacagagtgaccatta<br>actgcaaagcgtcccagaacatcaaccgctacctgaattggtaccagcagaagctgggggaa<br>gccccgaagctgctgatctacaacgcgaacagcctccagactggtattccttcccggttctccg<br>ggagcggctcgggtaccgatttcacccctcaccatctcctcccttcaacccgctgacgtggcca<br>cctacttctgcttgcaacataattctcggcctctgaccttcggaagcggcactatcctcgagatc<br>aagggcggtggaggctcagggggggcggctcggggggggtggaagcggaggagga<br>ggctcccaagtcactcttaaggaatccgggccaggactgttgcagccgagccagaccctgtc<br>cctcacttgtacctccgccggcttttcactgaacacccacggaatgggcgtgggatggattagg<br>cagccctcgggaaagggactggagtggctggccaacatttggtgggacgacgacaagtatta<br>caacccgagcctcaagaaccgcctgactatgtccaaggatacctccaacaaccaggccttcct<br>gaaaatcactaacgtggataccgctgacaccgaacgtactactgcgcccggatcgaaggtt<br>ccccgtcgtgacaactgtgttcgactactggggacagggcgtgatggtgaccgtgtcctcc |
| CAR20-14 - Soluble scFv - nt | 880 | atggccctccctgtcacgccctgctgcttccgctggctcttctgctccacgccgctcggcccg<br>acatccaaatgacccagtcacctagctttctgtcggcctcggtcggcgacagagtgaccattaa<br>ctgcaaagcgtcccagaacatcaaccgctacctgaattggtaccagcagaagctgggggaa<br>gccccgaagctgctgatctacaacgcgaacagcctccagactggtattccttcccggttctccg<br>ggagcggctcgggtaccgatttcacccctcaccatctcctcccttcaacccgctgacgtggcca<br>cctacttctgcttgcaacataattctcggcctctgaccttcggaagcggcactatcctcgagatc<br>aagggcggtggaggctcagggggggcggctcggggggggtggaagcggaggagga<br>ggctcccaagtcactcttaaggaatccgggccaggactgttgcagccgagccagaccctgtc<br>cctcacttgtacctccgccggcttttcactgaacacccacggaatgggcgtgggatggattagg<br>cagccctcgggaaagggactggagtggctggccaacatttggtgggacgacgacaagtatta<br>caacccgagcctcaagaaccgcctgactatgtccaaggatacctccaacaaccaggccttcct<br>gaaaatcactaacgtggataccgctgacaccgaacgtactactgcgcccggatcgaaggtt<br>ccccgtcgtgacaactgtgttcgactactggggacagggcgtgatggtgaccgtgtcctccg<br>gatcgcaccaccatcaccatcatcac |
| CAR20-14 - Soluble scFv - aa | 881 | malpvtalllplalllhaarpdiqmtqspsflsasvgdrvtinckasqninrylnwyqqklge<br>apklliynansllqtgipsrfsgsgsgtdftltisslqpadvatyfclqhnsrpltfgsgtileikgg<br>ggsggggsggggsggggsqvtlkesgpgllqpsqtlsltctfagfslnthgmgvgwirqps<br>gkglewlaniwwdddkyynpslknrltmskdtsnnqaflkitnvdtadtatyycariegsp<br>vvttvfdywgqgvmvtvssgshhhhhhhh |
| CAR20-14 - Full nt | 882 | atggccctccctgtcacgccctgctgcttccgctggctcttctgctccacgccgctcggcccg<br>acatccaaatgacccagtcacctagctttctgtcggcctcggtcggcgacagagtgaccattaa<br>ctgcaaagcgtcccagaacatcaaccgctacctgaattggtaccagcagaagctgggggaa<br>gccccgaagctgctgatctacaacgcgaacagcctccagactggtattccttcccggttctccg<br>ggagcggctcgggtaccgatttcacccctcaccatctcctcccttcaacccgctgacgtggcca<br>cctacttctgcttgcaacataattctcggcctctgaccttcggaagcggcactatcctcgagatc<br>aagggcggtggaggctcagggggggcggctcggggggggtggaagcggaggagga<br>ggctcccaagtcactcttaaggaatccgggccaggactgttgcagccgagccagaccctgtc<br>cctcacttgtacctccgccggcttttcactgaacacccacggaatgggcgtgggatggattagg<br>cagccctcgggaaagggactggagtggctggccaacatttggtgggacgacgacaagtatta<br>caacccgagcctcaagaaccgcctgactatgtccaaggatacctccaacaaccaggccttcct<br>gaaaatcactaacgtggataccgctgacaccgaacgtactactgcgcccggatcgaaggtt<br>ccccgtcgtgacaactgtgttcgactactggggacagggcgtgatggtgaccgtgtcctcca<br>ccactacccccagcaccgaggccacccaccccggcctctaccatcgcctcccagcctctgtcc<br>ctgcgtccggaggcatgtagacccgcagctggtggggccgtgcataccgggtgtcttgactt<br>cgcctgcgatatctacatttgggccctctggctggtacttgcggggtcctgctgctttcactcgt<br>gatcactctttactgtaagcgcggtcggaagaagctgctgtacatctttaagcaaccccttcatga<br>ggcctgtgcagactactaagaggaggacggctgttcatgccggttcccagaggaggagga<br>aggcggctgcgaactgcgcgtgaaattcagccgcagcgcagatgctccagcctacaagcag<br>gggcagaaccagctctacaacgaactcaatcttggtcggagagagagtacgacgtgctgg<br>acaagcggagaggacgggacccagaaatgggcgggaagccgcgcagaaagaatcccca<br>agagggcctgtacaacgagctccaaaaggataagatggcagaagcctatagcgagattgta<br>tgaaaggggaacgcagaagaggcaaaggccacgacggactgtaccagggactcagcacc<br>gccaccaaggacacctatgacgctcttcacatgcaggccctgccgcctcgg |
| CAR20-14 - Full aa | 883 | malpvtalllplalllhaarpdiqmtqspsflsasvgdrvtinckasqninrylnwyqqklge<br>apkllliynanslqtgipsrfsgsgsgtdftltisslqpadvatyfclqhnsrpltfgsgtileikgg<br>ggsggggsggggsggggsqvtlkesgpgllqpsqtlsltctfagfslnthgmgvgwirqps<br>gkglewlaniwwdddkyynpslknrltmskdtsnnqaflkitnvdtadtatyycariegsp<br>vvttvfdywgqgvmvtvsstttpaprpptpaptiasqplslrpeacrpaaggavhtrgldfa<br>cdiyiwaplagtcgvlllslvitlyckrgrkkllyifkqpfmrpvqtteedgcscrfpeeeeg<br>gcelrvkfsrsadapaykqgqnqlynelnlgrreeydvldkrrgrdpemggkprrknpqe<br>glynelqkdkmaeayseigmkgerrrgkghdglyqglstatkdtydalhmqalppr |
| CAR20-15 scFv domain | 884 | kivltqsptitaaspgekvtitclassrvsniywyqqksgaspkllliystsslasgvpyrfsgsg<br>sgtsysltintmeaedaatyychqwssnpwtfgggtklelkggsggggsggggsggggg<br>gsqvtlkesgpgmlqpsktlsltcsfsgfslstsgmvvswirqpsgkslewlaaiawdgdk<br>yynpslksrvtvskdtsntqvflritsvdiadtatyyctrrdydvgyyyfdfwgqgvmvtvss |
| CAR20-15 scFv | 885 | aagattgtgctgacccagagcccactattaccgccgcctccccgggggaaaaggtcaccat<br>cacttgtctggcgtcctcacgcgtgtcgaatatctactggtatcagcagaagtccggcgccagc |

TABLE 11A-continued

Rat CD20 CAR Constructs

| Name | SEQ ID NO: | Sequence |
|---|---|---|
| domain nt | | cccaagctgctgatctactcgacctcctccctcgcgtcgggagtgccttaccggttttctggctc<br>gggaagcggaaccagctactccttgaccatcaacaccatggaagccgaggacgctgccactt<br>actactgccaccagtggtcgagcaaccccttggactttcggtggaggcaccaaactcgagctca<br>agggcggtggaggctcagggggggcggctcggagggggtggaagcggaggaggag<br>gctcccaagtcaccctgaaagaatcgggtcccggaatgctgcagccatccaagacgctgtcc<br>cttacatgctccttctccgggttcagcctctcaacttccgggatggtggtgtcatggatcagaca<br>gccgagcggaaagtccctggagtggctggcggccatcgcatgggatggcgataagtactac<br>aacccgagcctgaagtcaagggtcactgtgtccaaggacacctccaacacccaagtgttcctt<br>cggatcacctccgtggacattgctgacaccgccacctattactgcactcgccgggactacgac<br>gtgggctactactacttcgatttctggggacagggtgtcatggtgaccgtgtcctcc |
| CAR20-15 - Soluble scFv - nt | 886 | atggccctccctgtcaccgccctgctgcttccgctggctcttctgctccacgccgctcggccca<br>agattgtgctgacccagagccccactattaccgccgcctcccgggggaaaaggtcaccatc<br>acttgtctggcgtcctcacgcgtgtcgaatatctactggtatcagcagaagtccggcgccagcc<br>ccaagctgctgatctactcgacctcctccctcgcgtcgggagtgccttaccggttttctggctcg<br>ggaagcggaaccagctactccttgaccatcaacaccatggaagccgaggacgctgccactta<br>ctactgccaccagtggtcgagcaaccccttggactttcggtggaggcaccaaactcgagctcaa<br>gggcggtggaggctcagggggggcggctcggagggggtggaagcggaggaggag<br>ctcccaagtcaccctgaaagaatcgggtcccggaatgctgcagccatccaagacgctgtccct<br>tacatgctccttctccgggttcagcctctcaacttccgggatggtggtgtcatggatcagacagc<br>cgagcggaaagtccctggagtggctggcggccatcgcatgggatggcgataagtactacaa<br>cccgagcctgaagtcaagggtcactgtgtccaaggacacctccaacacccaagtgttccttcg<br>gatcacctccgtggacattgctgacaccgccacctattactgcactcgccgggactacgacgt<br>gggctactactacttcgatttctggggacagggtgtcatggtgaccgtgtcctccggatcgcac<br>caccatcaccatcatcac |
| CAR20-15 - Soluble scFv - aa | 887 | malpvtalllplalllhaarpkivltqsptitaaspgekvtitclassrvsniywyqqksgaspk<br>lliyststsslasgvpyrfsgsgsgtsysltintmeaedaatyychqwssnpwtfgggtklelkg<br>ggsggggsggggsggggsqvtlkesgpgmlqpsktlsltcsfsgfslstsgmvvswirq<br>psgkslewlaaiawdgdkyynpslksrvtvskdtsntqvflritsvdiadtatyyctrrdydv<br>gyyyfdfwgqgvmvtvssgshhhhhhhh |
| CAR20-15 - Full nt | 888 | atggccctccctgtcaccgccctgctgcttccgctggctcttctgctccacgccgctcggccca<br>agattgtgctgacccagagccccactattaccgccgcctcccgggggaaaaggtcaccatc<br>acttgtctggcgtcctcacgcgtgtcgaatatctactggtatcagcagaagtccggcgccagcc<br>ccaagctgctgatctactcgacctcctccctcgcgtcgggagtgccttaccggttttctggctcg<br>ggaagcggaaccagctactccttgaccatcaacaccatggaagccgaggacgctgccactta<br>ctactgccaccagtggtcgagcaaccccttggactttcggtggaggcaccaaactcgagctcaa<br>gggcggtggaggctcagggggggcggctcggagggggtggaagcggaggaggag<br>ctcccaagtcaccctgaaagaatcgggtcccggaatgctgcagccatccaagacgctgtccct<br>tacatgctccttctccgggttcagcctctcaacttccgggatggtggtgtcatggatcagacagc<br>cgagcggaaagtccctggagtggctggcggccatcgcatgggatggcgataagtactacaa<br>cccgagcctgaagtcaagggtcactgtgtccaaggacacctccaacacccaagtgttccttcg<br>gatcacctccgtggacattgctgacaccgccacctattactgcactcgccgggactacgacgt<br>gggctactactacttcgatttctggggacagggtgtcatggtgaccgtgtcctccaccactacc<br>ccagcaccgaggccacccaccccggctcctaccatcgcctcccagcctctgtccctgcgtcc<br>ggaggcatgtagacccgcagctggtggggccgtgcatacccgggtcttgacttcgcctgcg<br>atatctacatttgggcccctctggctggtacttgcggggcctgctgcttttcactcgtgatcactct<br>ttactgtaagcgcggtcggaagaagctgctgtacatcttttaagcaacccttcatgaggcctgtg<br>cagactactcaagaggaggacggctgttcatgccggttcccagaggaggaggaaggcggct<br>gcgaactgcgcgtgaaattcagccgcagcgcagatgctccagcctacaagcaggggcaga<br>accagctctacaacgaactcaatcttggtcggagagaggagtacgacgtgctggacaagcgg<br>agaggacgggacccagaaatgggcgggaagccgcgcagaaagaatccccaagagggcct<br>gtacaacgagctccaaaagdataagatggcagaagcctatagcgagattggtatgaaaggg<br>gaacgcagaagaggcaaaggccacgacggactgtaccagggactcagcaccgccaccaa<br>ggacacctatgacgctcttcacatgcaggccctgccgcctcgg |
| CAR20-15 - Full aa | 889 | malpvtalllplalllhaarpkivltqsptitaaspgekvtitclassrvsniywyqqksgaspk<br>lliyststsslasgvpyrfsgsgsgtsysltintmeaedaatyychqwssnpwtfgggtklelkg<br>ggsggggsggggsggggsqvtlkesgpgmlqpsktlsltcsfsgfslstsgmvvswirq<br>psgkslewlaaiawdgdkyynpslksrvtvskdtsntqvflritsvdiadtatyyctrrdydv<br>gyyyfdfwgqgvmvtvsstttpaprpptpaptiasqplslrpeacrpaaggavhtrglqfac<br>diyiwaplagtcgvlllslvitlyckrgrkkllyifkqpfmrpvqttqeedgcscrfpeeeegg<br>celrvkfsrsadapaykqgqnqlynelnlgrreeydvldkrrgrdpemggkprrknpqeg<br>lynelqkdkmaeayseigmkgerrrgkghdglyqglstatkdtydalhmqalppr |
| CAR20-16 scFv domain | 890 | niqltqspsrlsasvgdrvtlsckgsqninnylawyqqklgeapklliyntnnlqtgipsrfsg<br>sgsgtdytftisglqpedvatyfccqynngntfgagtklelkggggsggggsggggsgggg<br>sqiqlvqsgpelkkpgesvkisckasgntvtgyamhwvrqapgkglkwmgwintysg<br>kptyaddfkgrcvfsleasastahlqisnlknedtatyfcarstyygykdwfaywgqgtlvt<br>vss |
| CAR20-16 scFv domain nt | 891 | aacatccaactgactcagagccccagccggctgtccgcctccgtgggggacagggtcacac<br>tgagctgcaaggggttctcagaacatcaacaactacctcgcgtggtaccagcagaagctggga<br>gaggcccccaagctgctcatctacaacaccaacaatctgcaaactggcattccatcgagattct |

TABLE 11A-continued

Rat CD20 CAR Constructs

| Name | SEQ ID NO: | Sequence |
|---|---|---|
| | | caggatcagggtccggtaccgactacaccttcacgatttcgggacttcagcctgaggatgtgg<br>ccacctacttctgctgtcagtacaacaacggcaacaccttcggtgctggcaccaagctggaac<br>tcaaaggcggtggaggctcagggggggcggctcgggaggggtggaagcggaggagg<br>aggctcccaaattcagttggtgcagtccggcccggagctgaagaagcctggagaatccgtga<br>agatctcgtgcaaagcttccgggaacaccgtgaccggatacgcaatgcactgggtccgccag<br>gcaccgggaaagggactgaagtggatggggtggatcaacacctcacgcggaaagccgact<br>tacgccgatgactttaaggacgctgtgtgttctccctggaagcgtccgcctcgactgcccatc<br>ttcaaatctccaacctgaagaatgaggacaccgccacttacttctgcgcccggagcacctatta<br>cggctacaaggactggttcgcgtattgggccagggcactctcgtgaccgtgtcctcc |
| CAR20-16 - Soluble scFv - nt | 892 | atggccctccctgtcaccgccctgctgcttccgctggctcttctgctccacgccgctcggccca<br>acatccaactgactcagagccccagccggctgtccgcctccgtggggacagggtcacact<br>gagctgcaagggttctcagaacatcaacaactacctcgcgtggtaccagcagaagctgggag<br>aggccccaagctgctcatctacaacaccaacaatctgcaaactggcattccatcgagattctc<br>aggatcagggtccggtaccgactacaccttcacgatttcgggacttcagcctgaggatgtggc<br>cacctacttctgctgtcagtacaacaacggcaacaccttcggtgctggcaccaagctggaact<br>caaaggcggtggaggctcagggggggcggctcgggaggggtggaagcggaggagg<br>aggctcccaaattcagttggtgcagtccggcccggagctgaagaagcctggagaatccgtga<br>agatctcgtgcaaagcttccgggaacaccgtgaccggatacgcaatgcactgggtccgccag<br>gcaccgggaaagggactgaagtggatggggtggatcaacacctcacgcggaaagccgact<br>tacgccgatgactttaaggacgctgtgtgttctccctggaagcgtccgcctcgactgcccatc<br>ttcaaatctccaacctgaagaatgaggacaccgccacttacttctgcgcccggagcacctatta<br>cggctacaaggactggttcgcgtattgggccagggcactctcgtgaccgtgtcctccggatc<br>gcaccaccatcaccatcatcac |
| CAR20-16 - Soluble scFv - aa | 893 | malpvtalllplalllhaarpniqltqspsrlsasvgdrvtlsckgsqninnylawyqqklgea<br>pklliyntnnlqtgipsrfsgsgsgtdytftisglqpedvatyfccqynngntfgagtklelkg<br>gggsgggsgggsgggsqiqlvqsgpelkkpgesvkisckasgntvtgyamhwvrq<br>apgkglwmgwintysgkptyaddfkgrcvfsleasastahlqisnlknedtatyfcarsty<br>ygykdwfaywgqgtlvtvssgshhhhhhhh |
| CAR20-16 - Full nt | 894 | atggccctccctgtcaccgccctgctgcttccgctggctcttctgctccacgccgctcggccca<br>acatccaactgactcagagccccagccggctgtccgcctccgtggggacagggtcacact<br>gagctgcaagggttctcagaacatcaacaactacctcgcgtggtaccagcagaagctgggag<br>aggccccaagctgctcatctacaacaccaacaatctgcaaactggcattccatcgagattctc<br>aggatcagggtccggtaccgactacaccttcacgatttcgggacttcagcctgaggatgtggc<br>cacctacttctgctgtcagtacaacaacggcaacaccttcggtgctggcaccaagctggaact<br>caaaggcggtggaggctcagggggggcggctcgggaggggtggaagcggaggagg<br>aggctcccaaattcagttggtgcagtccggcccggagctgaagaagcctggagaatccgtga<br>agatctcgtgcaaagcttccgggaacaccgtgaccggatacgcaatgcactgggtccgccag<br>gcaccgggaaagggactgaagtggatggggtggatcaacacctcacgcggaaagccgact<br>tacgccgatgactttaaggacgctgtgtgttctccctggaagcgtccgcctcgactgcccatc<br>ttcaaatctccaacctgaagaatgaggacaccgccacttacttctgcgcccggagcacctatta<br>cggctacaaggactggttcgcgtattgggccagggcactctcgtgaccgtgtcctccaccac<br>taccccagcaccgaggccacccaccccggctcctaccatcgcctcccagcctctgtccctgc<br>gtccggaggcatgtagacccgcagctggtggggccgtgcatacccggggtcttgacttcgcc<br>tgcgatatctacatttgggcccctctggctggtacttgcggggtcctgctgctttcactcgtgatc<br>actctttactgtaagcgcggtcggaagaagctgctgtacatcttttaagcaacccttcatgaggcc<br>tgtgcagactactcaagaggaggacggctgttcatgccggttcccagaggaggaggaaggc<br>ggctgcgaactgcgcgtgaaattcagccgcagcgcagatgctccagcctacaagcagggc<br>agaaccagctctacaacgaactcaatcttggtcggagagaggagtacgacgtgctggacaag<br>cggagaggacgggacccagaaatgggcggaagccgcgcagaaagaatcccaagagg<br>gcctgtacaacgagctccaaaaggataagatggcagaagcctatagcgagattggtatgaaa<br>ggggaacgcagaagaggcaaaggccacgacggactgtaccagggactcagcaccgccac<br>caaggacacctatgacgctcttcacatgcaggccctgccgcctcgg |
| CAR20-16 - Full aa | 895 | malpvtalllplalllhaarpniqltqspsrlsasvgdrvtlsckgsqninnylawyqqklgea<br>pklliyntnnlqtgipsrfsgsgsgtdytftisglqpedvatyfccqynngntfgagtklelkg<br>gggsgggsgggsgggsqiqlvqsgpelkkpgesvkisckasgntvtgyamhwvrq<br>apgkglwmgwintysgkptyaddfkgrcvfsleasastahlqisnlknedtatyfcarsty<br>ygykdwfaywgqgtlvtvssttttpaprppptpaptiasqplslrpeacrpaaggavhtrgldf<br>acdiyiwaplagtcgvlllslvitlyckrgrkkllyifkqpfmrpvqttqeedgcscrfpeeee<br>ggcelrvkfsrsadapaykqgqnqlynelnlgrreeydvldkrrgrdpemggkpprrknpq<br>eglynelqkdkmaeayseigmkgerrrgkghdglyqglstatkdtydalhmqalppr |

TABLE 11B

Humanized CD20 CAR Constructs

| Name | SEQ ID NO: | Sequence |
|---|---|---|
| CD20-3m scFv | 691 | QVQLVESGGGVVQPGRSLRLSCAASGFTFRDYYMAWVRQAPGKGL EWVASISYEGNPYYGDSVKGRFTISRDNAKSTLYLQMSSLRAEDTAV YYCARHDHNNVDWFAYWGQGTLVTVSSGGGGSGGGGSGGGGSGG GGSDIVMTQTPLSLSVTPGQPVSMSCKSSQSLLYSENKKNYLAWYL QKPGQSPQLLIFWASTRESGVPDRFSGSGSGTDFTLKISRVEAEDVGV YYCQQYYNFPTFGQGTKLEIK |
| CD20-3J scFv | 692 | QVQLVQSGAEVKKPGASVKVSCKASGFTFRDYYMAWVRQAPGQRL EWMGSISYEGNPYYGDSVKGRVTITRDNSASTLYMELSSLRSEDTAV YYCARHDHNNVDWFAYWGQGTLVTVSSGGGGSGGGGSGGGGSGG GGSDIQMTQSPSSLSASVGDRVTITCKSSQSLLYSENKKNYLAWYQQ KPGKVPKLLIFWASTRESGVPSRFSGSGSGTDFTLTISSLQPEDVATY YCQQYYNFPTFGQGTKLEIK |
| CD20-3H5k3 scFv | 693 | EVQLVQSGAEVKKPGESLKISCKGSGFTFRDYYMAWVRQMPGKGL EWMGSISYEGNPYYGDSVKGQVTISRDNSISTLYLQWSSLKASDTA MYYCARHDHNNVDWFAYWGQGTLVTVSSGGGGSGGGGSGGGGS GGGGSEIVMTQSPATLSLSPGERATLSCKSSQSLLYSENKKNYLAWY QQKPGQAPRLLIFWASTRESGIPARFSGSGSGTDFTLTISSLQPEDLAV YYCQQYYNFPTFGQGTKLEIK |
| CD20-3H5k1 scFv | 694 | EVQLVQSGAEVKKPGESLKISCKGSGFTFRDYYMAWVRQMPGKGL EWMGSISYEGNPYYGDSVKGQVTISRDNSISTLYLQWSSLKASDTA MYYCARHDHNNVDWFAYWGQGTLVTVSSGGGGSGGGGSGGGGS GGGGSDIQMTQSPSSLSASVGDRVTITCKSSQSLLYSENKKNYLAWY QQKPGKVPKLLIFWASTRESGVPSRFSGSGSGTDFTLTISSLQPEDVA TYYCQQYYNFPTFGQGTKLEIK |
| CD20-3H1k3 scFv | 695 | QVQLVQSGAEVKKPGASVKVSCKASGFTFRDYYMAWVRQAPGQG LEWMGSISYEGNPYYGDSVKGRVTMTRDNSTSTLYMELSSLRSEDT AVYYCARHDHNNVDWFAYWGQGTLVTVSSGGGGSGGGGSGGGGS GGGGSEIVMTQSPATLSLSPGERATLSCKSSQSLLYSENKKNYLAWY QQKPGQAPRLLIFWASTRESGIPARFSGSGSGTDFTLTISSLQPEDLAV YYCQQYYNFPTFGQGTKLEIK |
| CD20-3H1k1 scFv | 696 | QVQLVQSGAEVKKPGASVKVSCKASGFTFRDYYMAWVRQAPGQG LEWMGSISYEGNPYYGDSVKGRVTMTRDNSTSTLYMELSSLRSEDT AVYYCARHDHNNVDWFAYWGQGTLVTVSSGGGGSGGGGSGGGGS GGGGSDIQMTQSPSSLSASVGDRVTITCKSSQSLLYSENKKNYLAWY QQKPGKVPKLLIFWASTRESGVPSRFSGSGSGTDFTLTISSLQPEDVA TYYCQQYYNFPTFGQGTKLEIK |

In some embodiments, the antigen binding domain comprises a HC CDR1, a HC CDR2, and a HC CDR3 of any heavy chain binding domain amino acid sequences listed in Table 11A and 11B. In embodiments, the antigen binding domain further comprises a LC CDR1, a LC CDR2, and a LC CDR3. In embodiments, the antigen binding domain comprises a LC CDR1, a LC CDR2, and a LC CDR3 of any light chain binding domain amino acid sequences listed in Table 11A and 11B.

In some embodiments, the antigen binding domain comprises one, two or all of LC CDR1, LC CDR2, and LC CDR3 of any light chain binding domain amino acid sequences listed in Table 11A and 11B, and one, two or all of HC CDR1, HC CDR2, and HC CDR3 of any heavy chain binding domain amino acid sequences listed in Table 11A and 11B.

In some embodiments, the CDRs are defined according to the Kabat numbering scheme, the Chothia numbering scheme, or a combination thereof.

The sequences of human CDR sequences of the scFv domains are shown in Table 12A or 12B for the heavy chain variable domains and in Table 13 for the light chain variable domains. "ID" stands for the respective SEQ ID NO for each CDR.

TABLE 12A

Heavy Chain Variable Domain CDRs of CD20 CARs. CDRs are identified according to the "combined" definition.

| Candidate | HCDR1 | SEQ ID NO: | HCDR2 | SEQ ID NO: | HCDR3 | SEQ ID NO: |
|---|---|---|---|---|---|---|
| CAR20-1 | EYTFTDYAFH | 697 | WINTYSGKPTYADDFKG | 791 | DWFTY | 903 |
| CAR20-2 | GFTFSKYGMN | 698 | SISSTSIYIYYADTVKG | 792 | HDYSSYSY | 904 |
| CAR20-3 | GFTFRDYYMA | 699 | SISYEGNPYYGDSVKG | 793 | HDHNNVDWFAY | 905 |

TABLE 12A-continued

Heavy Chain Variable Domain CDRs of CD20 CARs. CDRs are identified according to the "combined" definition.

| Candidate | HCDR1 | SEQ ID NO: | HCDR2 | SEQ ID NO: | HCDR3 | SEQ ID NO: |
|---|---|---|---|---|---|---|
| CAR20-4 | RFSLSTYGMSVG | 778 | DIWWDDDKHYNPSLKN | 794 | SSTTDGIVTYVMDV | 906 |
| CAR20-5 | GFTFSSSGMQ | 779 | GIYYDSYKKSYADSVKG | 795 | SAYYGYKDYFDY | 907 |
| CAR20-6 | GFSLNTHGMGVG | 780 | NIWWDDDKYYNPSLKN | 796 | IEGSPVVTTVFDY | 908 |
| CAR20-7 | GFSLSTSGMVVS | 781 | AIAWDGDKYYNPSLKS | 797 | RDYDVGYYYFDF | 909 |
| CAR20-8 | GNTVTGYAMH | 782 | WINTYSGKPTYADDFKG | 798 | DWFAY | 910 |
| CAR20-9 | GFTFRDYYMA | 783 | SISYEGNPYYGDSVKG | 799 | HDHNNVDWFAY | 911 |
| CAR20-10 | GFTFSSSGMQ | 784 | GIYYDSYKKSYADSVKG | 896 | SAYYGYKDYFDY | 912 |
| CAR20-11 | EYTFTDYAFH | 785 | WINTYSGKPTYADDFKG | 897 | GAYYGYRDWFTY | 913 |
| CAR20-12 | GFTFSKYGMN | 786 | SISSTSIYIYYADTVKG | 898 | HDYSSYSY | 914 |
| CAR20-13 | RFSLSTYGMSVG | 787 | DIWWDDDKHYNPSLKN | 899 | SSTTDGIVTYVMDV | 915 |
| CAR20-14 | GFSLNTHGMGVG | 788 | NIWWDDDKYYNPSLKN | 900 | IEGSPVVTTVFDY | 916 |
| CAR20-15 | GFSLSTSGMVVS | 789 | AIAWDGDKYYNPSLKS | 901 | RDYDVGYYYFDF | 917 |
| CAR20-16 | GNTVTGYAMH | 790 | WINTYSGKPTYADDFKG | 902 | STYYGYKDWFAY | 918 |

TABLE 12B

Heavy Chain Variable Domain CDRs of CD20 CARs. CDRs are identified according to Kabat.

| Candidate | HCDR1 | SEQ ID NO: | HCDR2 | SEQ ID NO: | HCDR3 | SEQ ID NO: |
|---|---|---|---|---|---|---|
| CAR20-1 | DYAFH | 1481 | WINTYSGKPTYADDFKG | 1497 | GAYYGYRDWFTY | 1513 |
| CAR20-2 | KYGMN | 1482 | SISSTSIYIYYADTVKG | 1498 | HDYSSYSY | 1514 |
| CAR20-3 | DYYMA | 1483 | SISYEGNPYYGDSVKG | 1499 | HDHNNVDWFAY | 1515 |
| CAR20-4 | TYGMSVG | 1484 | DIWWDDDKHYNPSLKN | 1500 | SSTTDGIVTYVMDV | 1516 |
| CAR20-5 | SSGMQ | 1485 | GIYYDSYKKSYADSVKG | 1501 | SAYYGYKDYFDY | 1517 |
| CAR20-6 | THGMGVG | 1486 | NIWWDDDKYYNPSLKN | 1502 | IEGSPVVTTVFDY | 1518 |
| CAR20-7 | TSGMVVS | 1487 | AIAWDGDKYYNPSLKS | 1503 | RDYDVGYYYFDF | 1519 |
| CAR20-8 | GYAMH | 1488 | WINTYSGKPTYADDFKG | 1504 | STYYGYKDWFAY | 1520 |
| CAR20-9 | DYYMA | 1489 | SISYEGNPYYGDSVKG | 1505 | HDHNNVDWFAY | 1521 |
| CAR20-10 | SSGMQ | 1490 | GIYYDSYKKSYADSVKG | 1506 | SAYYGYKDYFDY | 1522 |
| CAR20-11 | DYAFH | 1491 | WINTYSGKPTYADDFKG | 1507 | GAYYGYRDWFTY | 1523 |
| CAR20-12 | KYGMN | 1492 | SISSTSIYIYYADTVKG | 1508 | HDYSSYSY | 1524 |
| CAR20-13 | TYGMSVG | 1493 | DIWWDDDKHYNPSLKN | 1509 | SSTTDGIVTYVMDV | 1525 |
| CAR20-14 | THGMGVG | 1494 | NIWWDDDKYYNPSLKN | 1510 | IEGSPVVTTVFDY | 1526 |
| CAR20-15 | TSGMVVS | 1495 | AIAWDGDKYYNPSLKS | 1511 | RDYDVGYYYFDF | 1527 |
| CAR20-16 | GYAMH | 1496 | WINTYSGKPTYADDFKG | 1512 | STYYGYKDWFAY | 1528 |

TABLE 13

Light Chain Variable Domain CDRs of CD20 CARs.
The LC CDR sequences in this table have the same
sequence under the Kabat or combined definitions.

| Candidate | LCDR1 | SEQ ID NO: | LCDR2 | SEQ ID NO: | LCDR3 | SEQ ID NO: |
|---|---|---|---|---|---|---|
| CAR20-1 | KSSQSLLYSENKKNYLA | 919 | WASTRES | 935 | QQYYNFPPWT | 951 |
| CAR20-2 | KINSGNIGSYFIH | 920 | RDDKRPH | 936 | HSYDSGINIV | 952 |
| CAR20-3 | KSSQSLLYSENKKNYLA | 921 | WASTRES | 937 | QQYYNFPT | 953 |
| CAR20-4 | KASQNINRYLN | 922 | SANSLQT | 938 | LQHNSWPLT | 954 |
| CAR20-5 | QASQNINKYIA | 923 | YTSTLES | 939 | LQYDDLPYT | 955 |
| CAR20-6 | KASQNINRYLN | 924 | NANSLQT | 940 | LQHNSRPLT | 956 |
| CAR20-7 | LASSRVSNIY | 925 | STSSLAS | 941 | HQWSSNPWT | 957 |
| CAR20-8 | KGSQNINNYLA | 926 | NTNNLQT | 942 | CQYNNGNT | 958 |
| CAR20-9 | KSSQSLLYSENKKNYLA | 927 | WASTRES | 943 | QQYYNFPT | 959 |
| CAR20-10 | QASQNINKYIA | 928 | YTSTLES | 944 | LQYDDLPYT | 960 |
| CAR20-11 | KSSQSLLYSENKKNYLA | 929 | WASTRES | 945 | QQYYNFPPWT | 961 |
| CAR20-12 | KINSGNIGSYFIH | 930 | RDDKRPH | 946 | HSYDSGINIV | 962 |
| CAR20-13 | KASQNINRYLN | 931 | SANSLQT | 947 | LQHNSWPLT | 963 |
| CAR20-14 | KASQNINRYLN | 932 | NANSLQT | 948 | LQHNSRPLT | 964 |
| CAR20-15 | LASSRVSNIY | 933 | STSSLAS | 949 | HQWSSNPWT | 965 |
| CAR20-16 | KGSQNINNYLA | 934 | NTNNLQT | 950 | CQYNNGNT | 966 |

TABLE 14A

Heavy Chain Variable Regions of CD20 antibody molecules

| Candidate | SEQ ID NO: | Heavy Chain Variable region |
|---|---|---|
| CAR-1 | 967 | QIQLVQSGPELKKPGESVKISCKTSEYTFTDYAFHWVKQAPGKGLK WMGWINTYSGKPTYADDFKGRFVFSLEDSARTANLQISNLKNEDTA TYFCARGAYYGYRDWFTYWGQGTLVTV |
| CAR20-2 | 968 | EVQLVESGGGLVQPGRSLKLSCLASGFTFSKYGMNWIRQAPGKGLE WVASISSTSIYIYYADTVKGRFTISRENAKNTLYLQMTSLRSEDTALY YCARHDYSSYSYWGQGVMVTV |
| CAR20-3 | 969 | EVQLVESGGGLVQPGRSLKLSCAASGFTFRDYYMAWVRQAPKKGL EWVASISYEGNPYYGDSVKGRFTISRNNAKSTLYLQMNSLRSEDTAT YYCARHDHNNVDWFAYWGQGTLVTV |
| CAR20-4 | 970 | QVTLKESGPGILQPSQTLSLTCTFTRFSLSTYGMSVGWIRQPSGKGLE WLADIWWDDDKHYNPSLKNRLTISKDTSKNQAFLKITNVDTADTAT YYCARSSTTDGIVTYVMDVWGQGASVTV |
| CAR20-5 | 971 | EVQLVESGGGLVQPGTSLKLSCVASGFTFSSSGMQWIRQAPKKGLE WISGIYYDSYKKSYADSVKGRFTISRDNSKNTLYLEMNSLRSEDTAT YYCAKSAYYGKDYFDYWGQGVMVTV |
| CAR20-6 | 972 | QVTLKESGPGLLQPSQTLSLTCTFAGFSLNTHGMGVGWIRQPSGKGL EWLANIWWDDDKYYNPSLKNRLTMSKDTSNNQAFLKITNVDTADT ATYYCARIEGSPVVTTVFDYWGQGVMVTV |
| CAR20-7 | 973 | QVTLKESGPGMLQPSKTLSLTCSFSGFSLSTSGMVVSWIRQPSGKSLE WLAAIAWDGDKYYNPSLKSRVTVSKDTSNTQVFLRITSVDIADTATY YCTRRDYDVGYYYFDFWGQGVMVTV |

TABLE 14A-continued

Heavy Chain Variable Regions of CD20 antibody molecules

| Candidate | SEQ ID NO: | Heavy Chain Variable region |
|---|---|---|
| CAR20-8 | 974 | QIQLVQSGPELKKPGESVKISCKASGNTVTGYAMHWVRQAPGKGLKWMGWINTYSGKPTYADDFKGRCVFSLEASASTAHLQISNLKNEDTATYFCARSTYYGYKDWFAYWGQGTLVTV |
| CAR20-9 | 975 | EVQLVESGGGLVQPGRSLKLSCAASGFTFRDYYMAWVRQAPKKGLEWVASISYEGNPYYGDSVKGRFTISRNNAKSTLYLQMNSLRSEDTATYYCARHDHNNVDWFAYWGQGTLVTV |
| CAR20-10 | 976 | EVQLVESGGGLVQPGTSLKLSCVASGFTFSSSGMQWIRQAPKKGLEWISGIYYDSYKKSYADSVKGRFTISRDNSKNTLYLEMNSLRSEDTATYYCAKSAYYGYKDYFDYWGQGVMVTV |
| CAR20-11 | 977 | QIQLVQSGPELKKPGESVKISCKTSEYTFTDYAFHWVKQAPGKGLKWMGWINTYSGKPTYADDFKGRFVFSLEDSARTANLQISNLKNEDTATYFCARGAYYGYRDWFTYWGQGTLVTV |
| CAR20-12 | 978 | EVQLVESGGGLVQPGRSLKLSCLASGFTFSKYGMNWIRQAPGKGLEWVASISSTSIYIYYADTVKGRFTISRENAKNTLYLQMTSLRSEDTALYYCARHDYSSYSYWGQGVMVTV |
| CAR20-13 | 979 | QVTLKESGPGILQPSQTLSLTCTFTRFSLSTYGMSVGWIRQPSGKGLEWLADIWWDDDKHYNPSLKNRLTISKDTSKNQAFLKITNVDTADTATYYCARSSTTDGIVTYVMDVWGQGASVTV |
| CAR20-14 | 980 | QVTLKESGPGLLQPSQTLSLTCTFAGFSLNTHGMGVGWIRQPSGKGLEWLANIWWDDDKYYNPSLKNRLTMSKDTSNNQAFLKITNVDTADTATYYCARIEGSPVVTTVFDYWGQGVMVTV |
| CAR20-15 | 981 | QVTLKESGPGMLQPSKTLSLTCSFSGFSLSTSGMVVSWIRQPSGKSLEWLAAIAWDGDKYYNPSLKSRVTVSKDTSNTQVFLRITSVDIADTATYYCTRRDYDVGYYYFDFWGQGVMVTV |
| CAR20-16 | 982 | QIQLVQSGPELKKPGESVKISCKASGNTVTGYAMHWVRQAPGKGLKWMGWINTYSGKPTYADDFKGRCVFSLEASASTAHLQISNLKNEDTATYFCARSTYYGYKDWFAYWGQGTLVTV |

TABLE 14B

Heavy Chain Variable Regions of Humanized CD20 antibody molecules

| Candidate | SEQ ID NO: | Heavy Chain Variable region |
|---|---|---|
| CD20-3_VH1_1-46 | 983 | QVQLVQSGAEVKKPGASVKVSCKASGFTFRDYYMAWVRQAPGQGLEWMGSISYEGNPYYGDSVKGRVTMTRDNSTSTLYMELSSLRSEDTAVYYCARHDHNNVDWFAYWGQGTLVTVSS |
| CD20-3_VH5_5-51 | 984 | EVQLVQSGAEVKKPGESLKISCKGSGFTFRDYYMAWVRQMPGKGLEWMGSISYEGNPYYGDSVKGQVTISRDNSISTLYLQWSSLKASDTAMYYCARHDHNNVDWFAYWGQGTLVTVSS |
| CD20-3_VH M | 985 | QVQLVESGGGVVQPGRSLRLSCAASGFTFRDYYMAWVRQAPGKGLEWVASISYEGNPYYGDSVKGRFTISRDNAKSTLYLQMSSLRAEDTAVYYCARHDHNNVDWFAYWGQGTLVTVSS |
| CD20-3_VH J | 986 | QVQLVQSGAEVKKPGASVKVSCKASGFTFRDYYMAWVRQAPGQRLEWMGSISYEGNPYYGDSVKGRVTITRDNSATLYMELSSLRSEDTAVYYCARHDHNNVDWFAYWGQGTLVTVSS |

TABLE 15A

Light Chain Variable Regions of CD20 antibody molecules

| Candidate | SEQ ID NO: | Light Chain Variable region |
|---|---|---|
| CAR20-1 | 987 | DIVMTQTPSSQAVSAGEKVTMSCKSSQSLLYSENKKNYLAWYQQKPG<br>QSPKLLIYWASTRESGVPDRFIGSGSGTDFTLTISSVQAEDLAVYYCQQ<br>YYNFPPWTFGGGTKLELK |
| CAR20-2 | 988 | QVVLTQPKSVSTSLESTVKLSCKINSGNIGSYFIHWYQQHEGRSPTTMI<br>YRDDKRPHGVPDRFSGSIDSSSNSAFLTINNVQTEDEAIYFCHSYDSGIN<br>IVFGGGTKLTVL |
| CAR20-3 | 989 | DIVMTQTPSSQAVSAGEKVTMSCKSSQSLLYSENKKNYLAWYQQKPG<br>QSPKLLIFWASTRESGVPDRFIGSGSGTDFTLTISSVQAEDLAVYYCQQ<br>YYNFPTFGSGTKLEIK |
| CAR20-4 | 990 | DVQMTQSPSLLSASVGDAVTINCKASQNINRYLNWYQQKLEGPRLLI<br>YSANSLQTGIPSRFSGSGSGADFTLTITSPQPEDVATYFCLQHNSWPLTF<br>GSGTKLEIK |
| CAR20-5 | 991 | DIQMTQSPPSLSASLGDKVTITCQASQNINKYIAWYQQKPGKAPRLLIR<br>YTSTLESGTPSRFSGSGSGRDYSFSISNVESGDVASYYCLQYDDLPYTF<br>GPGTKLELK |
| CAR20-6 | 992 | DIQMTQSPSFLSASVGDRVTINCKASQNINRYLNWYQQKLGEAPKLLI<br>YNANSLQTGIPSRFSGSGSGTDFTLTISSLQPADVATYFCLQHNSRPLTF<br>GSGTILEIK |
| CAR20-7 | 993 | KIVLTQSPTITAASPGEKVTITCLASSRVSNIYWYQQKSGASPKLLIYSTS<br>SLASGVPYRFSGSGSGTSYSLTINTMEAEDAATYYCHQWSSNPWTFGG<br>GTKLELK |
| CAR20-8 | 994 | NIQLTQSPSRLSASVGDRVTLSCKGSQNINNYLAWYQQKLGEAPKLLI<br>YNTNNLQTGIPSRFSGSGSGTDYTFTISGLQPEDVATYFCCQYNNGNTF<br>GAGTKLELK |
| CAR20-9 | 995 | DIVMTQTPSSQAVSAGEKVTMSCKSSQSLLYSENKKNYLAWYQQKPG<br>QSPKLLIFWASTRESGVPDRFIGSGSGTDFTLTISSVQAEDLAVYYCQQ<br>YYNFPTFGSGTKLEIK |
| CAR20-10 | 996 | DIQMTQSPPSLSASLGDKVTITCQASQNINKYIAWYQQKPGKAPRLLIR<br>YTSTLESGTPSRFSGSGSGRDYSFSISNVESGDVASYYCLQYDDLPYTF<br>GPGTKLELK |
| CAR20-11 | 997 | DIVMTQTPSSQAVSAGEKVTMSCKSSQSLLYSENKKNYLAWYQQKPG<br>QSPKLLIYWASTRESGVPDRFIGSGSGTDFTLTISSVQAEDLAVYYCQQ<br>YYNFPPWTFGGGTKLELK |
| CAR20-12 | 998 | QVVLTQPKSVSTSLESTVKLSCKINSGNIGSYFIHWYQQHEGRSPTTMI<br>YRDDKRPHGVPDRFSGSIDSSSNSAFLTINNVQTEDEAIYFCHSYDSGIN<br>IVFGGGTKLTVL |
| CAR20-13 | 999 | DVQMTQSPSLLSASVGDAVTINCKASQNINRYLNWYQQKLEGPRLLI<br>YSANSLQTGIPSRFSGSGSGADFTLTITSPQPEDVATYFCLQHNSWPLTF<br>GSGTKLEIK |
| CAR20-14 | 1000 | DIQMTQSPSFLSASVGDRVTINCKASQNINRYLNWYQQKLGEAPKLLI<br>YNANSLQTGIPSRFSGSGSGTDFTLTISSLQPADVATYFCLQHNSRPLTF<br>GSGTILEIK |
| CAR20-15 | 1001 | KIVLTQSPTITAASPGEKVTITCLASSRVSNIYWYQQKSGASPKLLIYSTS<br>SLASGVPYRFSGSGSGTSYSLTINTMEAEDAATYYCHQWSSNPWTFGG<br>GTKLELK |
| CAR20-16 | 1002 | NIQLTQSPSRLSASVGDRVTLSCKGSQNINNYLAWYQQKLGEAPKLLI<br>YNTNNLQTGIPSRFSGSGSGTDYTFTISGLQPEDVATYFCCQYNNGNTF<br>GAGTKLELK |

TABLE 15B

Light Chain Variable Regions of Humanized CD20 antibody molecules

| Candidate | SEQ ID NO: | Light Chain Variable region |
|---|---|---|
| CD20-3_VK1_A20 | 1003 | DIQMTQSPSSLSASVGDRVTITCKSSQSLLYSENKKNYLAWYQQK PGKVPKLLIFWASTRESGVPSRFSGSGSGTDFTLTISSLQPEDVATY YCQQYYNFPTFGQGTKLEIK |
| CD20-3_VK3_L25 | 1004 | EIVMTQSPATLSLSPGERATLSCKSSQSLLYSENKKNYLAWYQQK PGQAPRLLIFWASTRESGIPARFSGSGSGTDFTLTISSLQPEDLAVY YCQQYYNFPTFGQGTKLEIK |
| CD20-3_VL M and CD20-3_VL J | 1005 | DIVMTQTPLSLSVTPGQPVSMSCKSSQSLLYSENKKNYLAWYLQK PGQSPQLLIFWASTRESGVPDRFSGSGSGTDFTLKISRVEAEDVGV YYCQQYYNFPTFGQGTKLEIK |

In some embodiments, the antigen binding domain comprises a HC CDR1, a HC CDR2, and a HC CDR3 of any heavy chain binding domain amino acid sequences listed in Table 14A or 14B. In embodiments, the antigen binding domain further comprises a LC CDR1, a LC CDR2, and a LC CDR3. In embodiments, the antigen binding domain comprises a LC CDR1, a LC CDR2, and a LC CDR3 of any light chain binding domain amino acid sequences listed in Table 15A or 15B.

In some embodiments, the antigen binding domain comprises one, two or all of LC CDR1, LC CDR2, and LC CDR3 of any light chain binding domain amino acid sequences listed in Table 15A or 15B, and one, two or all of HC CDR1, HC CDR2, and HC CDR3 of any heavy chain binding domain amino acid sequences listed in Table 14A or 14B.

In some embodiments, the CDRs are defined according to the Kabat numbering scheme, the Chothia numbering scheme, or a combination thereof.

CAR123 Constructs

Anti-CD123 single chain variable fragments were isolated. Anti-CD123 scFvs were cloned into lentiviral CAR expression vectors with the CD3zeta chain and the 4-1BB costimulatory molecule. CAR-containing plasmids were amplified by bacterial transformation in STBL3 cells, followed by Maxiprep using endotoxin-free Qiagen Plasmid Maki kit. Lentiviral supernatant was produced in 293T cells using standard techniques.

The sequences of the CARs are provided below in Table 16. Additional components of CARs (e.g., leader, hinge, transmembrane, and signalling domains) are described herein.

The order in which the VL and VH domains appear in the scFv was varied (i.e., VL-VH, or VH-VL orientation), and where either three or four copies of the "G4S" (SEQ ID NO:18) subunit, in which each subunit comprises the sequence GGGGS (SEQ ID NO:18) (e.g., (G4S)$_3$ (SEQ ID NO:107) or (G4S)$_4$(SEQ ID NO:106)), connect the variable domains to create the entirety of the scFv domain.

The sequences of the human CARs are provided below in Table 16.

These clones all contained a Q/K residue change in the signal domain of the co-stimulatory domain derived from CD3zeta chain.

TABLE 16

Human CD123 CAR Constructs

| Name | SEQ ID | Sequence |
|---|---|---|
| CAR123-1 NT | 1123 | atggccctccctgtcaccgccctgctgcttccgctggctcttctgctccacgccgc tcggccccaagtccaactcgtccagtcaggagcggaagtcaagaagcccggagcgt cagtcaaagtgtcatgcaaagcctcgggctacactttcactgggtactacatgcac tgggtgcgccaggctccaggacagggactggaatggatgggatggatcaacccgaa ctccggtggcaccaattacgcccagaagttccagggggagggtgaccatgactcgcg acacgtcgatcagcaccgcatacatggagctgtcaagactccggtccgacgatact gccgtgtactactgcgcacgggacatgaacattctggccaccgtgccttttgacat ctggggtcagggaactatggttaccgtgtcctctggtggaggcggctccggcgggg ggggaagcggaggcggtggaagcgacattcagatgacccagtcgccttcatccctt tcggcgagcgtgggagatcgcgtcactatcacttgtcgggcctcgcagtccatctc cacctacctcaattggtaccagcagaagccaggaaaagcaccgaatctgctgatct acgccgcgttttccttgcaatcgggagtgccaagcagattcagcggatcgggatca ggcactgatttcaccctcaccatcaactcgctgcaaccggaggatttcgctacgta ctattgccaacaaggagacagcgtgccgctcaccttcggcggaggggactaagctgg aaatcaagaccactaccccagcaccgaggccaccccaccccggctcctaccatcgcc tcccagcctctgtccctgcgtccggaggcatgtagacccgcagctggtggggccgt gcatacccggggtcttgacttcgcctgcgatatctacattttgggccctctggctg gtacttgcggggtcctgctgctttcactcgtgatcactctttactgtaagcgcggt cggaagaagctgctgtacatctttaagcaacccttcatgaggcctgtgcagactac tcaagaggaggacgcctgttcatgccggttcccagaggaggaggaaggcggctgcg aactgcgcgtgaaattcagccgcagcgcagatgctccagcctacaagcaggggcag aaccagctctacaacgaactcaatcttggtcggagagaggagtacgacgtgctgga caagcggagaggacgggacccagaaatgggcgggaagccgcgcagaaagaatcccc aagagggcctgtacaacgagctccaaaaggataagatggcagaagcctatagcgag attggtatgaaaggggaacgcagaagaggcaaaggccacgacggactgtaccaggg |

TABLE 16-continued

Human CD123 CAR Constructs

| Name | SEQ ID | Sequence |
|---|---|---|
| | | actcagcaccgccaccaaggacacctatgacgctcttcacatgcaggccctgccgc<br>ctcgg |
| CAR123-1<br>AA | 1124 | MALPVTALLLPLALLLHAARPQVQLVQSGAEVKKPGASVKVSCKASGYTFTGYYMHWVRQAP<br>GQGLEWMGWINPNSGGTNYAQKFQGRVTMTRDTSISTAYMELSRLRSDDTAVYYCARDMNIL<br>ATVPFDIWGQGTMVTVSSGGGGSGGGGSGGGGSDIQMTQSPSSLSASVGDRVTITCRASQSI<br>STYLNWYQQKPGKAPNLLIYAAFSLQSGVPSRFSGSGSGTDFTLTINSLQPEDFATYYCQQG<br>DSVPLTFGGGTKLEIKTTTPAPRPPTPAPTIASQPLSLRPEACRPAAGGAVHTRGLDFACDI<br>YIWAPLAGTCGVLLLSLVITLYCKRGRKKLLYIFKQPFMRPVQTTQEEDGCSCRFPEEEEGG<br>CELRVKFSRSADAPAYKQGQNQLYNELNLGRREEYDVLDKRRGRDPEMGGKPRRKNPQEGLY<br>NELQKDKMAEAYSEIGMKGERRRGKGHDGLYQGLSTATKDTYDALHMQALPPR |
| CAR123-1<br>scFv | 1125 | MALPVTALLLPLALLLHAARPQVQLVQSGAEVKKPGASVKVSCKASGYTFTGYYMHWVRQAP<br>GQGLEWMGWINPNSGGTNYAQKFQGRVTMTRDTSISTAYMELSRLRSDDTAVYYCARDMNIL<br>ATVPFDIWGQGTMVTVSSGGGGSGGGGSGGGGSDIQMTQSPSSLSASVGDRVTITCRASQSI<br>STYLNWYQQKPGKAPNLLIYAAFSLQSGVPSRFSGSGSGTDFTLTINSLQPEDFATYYCQQG<br>DSVPLTFGGGTKLEIK |
| CAR123-1<br>VH | 1126 | QVQLVQSGAEVKKPGASVKVSCKASGYTFTGYYMHWVRQAPGQGLEWMGWINPNSGGTNYAQ<br>KFQGRVTMTRDTSISTAYMELSRLRSDDTAVYYCARDMNILATVPFDIWGQGTMVTVSS |
| CAR123-1<br>VL | 1127 | DIQMTQSPSSLSASVGDRVTITCRASQSISTYLNWYQQKPGKAPNLLIYAAFSLQSGVPSRF<br>SGSGSGTDFTLTINSLQPEDFATYYCQQGDSVPLTFGGGTKLEIK |
| CAR123-2<br>NT | 1128 | atggccctccctgtcaccgccctgctgcttccgctggctcttctgctccacgccgctcggcc<br>ccaagtgcaactcgtccaaagcggagcggaagtcaagaaacccggagcgagcgtgaaagtgt<br>cctgcaaagcctccggctacacctttacgggctactacatgcactgggtgcgccaggcacca<br>ggacagggtcttgaatggatgggatggatcaaccctaattcgggcggaactaactacgcaca<br>gaagttccaggggagagtgactctgactcgggatacctccatctcaactgtctacatggaac<br>tctcccgcttgcggtcagatgatacgacgagtatatcctg<br>gctaccgtgccgttcgacatctggggacaggggactatggttactgtctcatcgggcggtgg<br>aggttcaggaggaggcggctcgggaggcggaggttcggacattcagatgacccagtccccat<br>cctctctgtcggccagcgtcggagatagggtgaccattacctgtcgggcctcgcaaagcatc<br>tcctcgtacctcaactggtatcagcaaaagccgggaaaggcgctaagctgctgatctacgc<br>cgcttcgagcttgcaaagcggggtgccatccagattctcgggatcaggctcaggaaccgact<br>tcaccctgaccgtgaacagcctccagccgaggactttgccacttactactgccagcaggga<br>gactccgtgccgcttactttcgggggggtacccgcctggagatcaagaccactaccccagc<br>accgaggccaccccaccccggctcctaccatcgcctcccagcctctgtccctgcgtccggagg<br>catgtagacccgcagctggtggggccgtgcatacccgggtcttgacttcgcctgcgatatc<br>tacatttgggcccctctggctggtacttgcggggtcctgctgctttcactcgtgatcactct<br>ttactgtaagcgcggtcggaagaagctgctgtacatcttaagcaacccttcatgaggcctg<br>tgcagactactcaagaggaggacggctgttcatgccggttcccagaggaggaggaagacgc<br>tgcgaactgcgcgtgaaattcagccgcagcgcagatgctccagcctacaagcaggggcagaa<br>ccagctctacaacgaactcaatcttggtcggagagaggagtacgacgtgctggacaagcgga<br>gaggacgggacccagaaatgggcgggaagccgcgcagaaagaatccccaagagggcctgtac<br>aacgagctccaaaaggataagatggcagaagcctatagcgagattggtatgaaggggaacg<br>cagaagaggcaaaggccacgacggactgtaccagggactcagcaccgccaccaaggacacct<br>atgacgctcttcacatgcaggccctgccgcctcgg |
| CAR123-2<br>AA | 1129 | MALPVTALLLPLALLLHAARPQVQLVQSGAEVKKPGASVKVSCKASGYTFTGYYMHWVRQAP<br>GQGLEWMGWINPNSGGTNYAQKFQGRVTLTRDTSISTVYMELSRLRSDDTAVYYCARDMNIL<br>ATVPFDIWGQGTMVTVSSGGGGSGGGGSGGGGSDIQMTQSPSSLSASVGDRVTITCRASQSI<br>SSYLNWYQQKPGKAPKLLIYAASSLQSGVPSRFSGSGSGTDFTLTVNSLQPEDFATYYCQQG<br>DSVPLTFGGGTRLEIKTTTPAPRPPTPAPTIASQPLSLRPEACRPAAGGAVHTRGLDFACDI<br>YIWAPLAGTCGVLLLSLVITLYCKRGRKKLLYIFKQPFMRPVQTTQEEDGCSCRFPEEEEGG<br>CELRVKFSRSADAPAYKQGQNQLYNELNLGRREEYDVLDKRRGRDPEMGGKPRRKNPQEGLY<br>NELQKDKMAEAYSEIGMKGERRRGKGHDGLYQGLSTATKDTYDALHMQALPPR |
| CAR123-2<br>scFv | 1130 | MALPVTALLLPLALLLHAARPQVQLVQSGAEVKKPGASVKVSCKASGYTFTGYYMHWVRQAP<br>GQGLEWMGWINPNSGGTNYAQKFQGRVTLTRDTSISTVYMELSRLRSDDTAVYYCARDMNIL<br>ATVPFDIWGQGTMVTVSSGGGGSGGGGSGGGGSDIQMTQSPSSLSASVGDRVTITCRASQSI<br>SSYLNWYQQKPGKAPKLLIYAASSLQSGVPSRFSGSGSGTDFTLTVNSLQPEDFATYYCQQG<br>DSVPLTFGGGTRLEIK |
| CAR123-2<br>VH | 1131 | QVQLVQSGAEVKKPGASVKVSCKASGYTFTGYYMHWVRQAPGQGLEWMGWINPNSGGTNYAQ<br>KFQGRVTLTRDTSISTVYMELSRLRSDDTAVYYCARDMNILATVPFDIWGQGTMVTVSS |
| CAR123-2<br>VL | 1132 | DIQMTQSPSSLSASVGDRVTITCRASQSISSYLNWYQQKPGKAPKLLIYAASSLQSGVPSRF<br>SGSGSGTDFTLTVNSLQPEDFATYYCQQGDSVPLTFGGGTRLEIK |
| CAR123-3<br>NT | 1133 | atggccctccctgtcaccgccctgctgcttccgctggctcttctgctccacgccgctcggcc<br>ccaagtccaactcgttcaatccggcgcagaagtcaagaagcaggagcatcagtgaaagtgt<br>cctgcaaagcctcaggctacatcttcacgggatactacatccactgggtgcgccaggctccg<br>ggccagggccttgagtggatgggctggatcaaccctaactctggggaaccaactacgctca<br>gaagttccaggggagggtcactatgactcgcgatacctccatctccactgcgtacatggaac<br>tctcgggactgagatccgacgatcctgccgtgtactactgcgccccgggacatgaacatcttg |

TABLE 16-continued

Human CD123 CAR Constructs

| Name | SEQ ID | Sequence |
|---|---|---|
| | | gcgaccgtgccgtttgacatttggggacagggcaccctcgtcactgtgtcgagcggtggagg<br>aggctcgggggtggcggatcaggaggggaggaagcgcatccagctgactcagagcccat<br>cgtcgttgtccgcgtcggtgggggatagagtgaccattacttgccgcgccagccagagcatc<br>tcatcatatctgaattggtaccagcagaagcccggaaaggcccccaaaactgctgatctacgc<br>tgcaagcagcctccaatcgggagtgccgtcacggttctccggttcgggaactgact<br>ttaccctgaccgtgaattcgctgcaaccggaggatttcgccacgtactactgtcagcaagga<br>gactccgtgccgctgaccttcggtggaggcaccaaggtcgaaatcaagaccactaccccagc<br>accgaggccacccacccggctcctaccatcgcctcccagcctctgtccctgcgtccggagg<br>catgtagacccgcagctggtggggccgtgcatacccggggtcttgacttcgcctgcgatatc<br>tacatttgggcccctctggctggtacttgcgggtcctgctgcttcactcgtgatcactct<br>ttactgtaagcgcggtcggaagaagctgctgtacatctttaagcaacccttcatgaggcctg<br>tgcagactactcaagaggaggacggctgttcatgccggttcccagaggaggaggaaggcggc<br>tgcgaactgcgcgtgaaattcagccgcagcgcagatgctccagcctacaagcaggggcagaa<br>ccagctctacaacgaactcaatcttggtcggagagaggagtacgacgtgctggacaagcgga<br>gaggacgggacccagaaatgggcgggaagccgcgcagaaagaatcccaagagggcctgtac<br>aacgagctccaaaaggataagatggcagaagcctatagcgagattggtatgaaaggggaacg<br>cagaagaggcaaaggccacgacggactgtaccagggactcagcaccgccaccaaggacacct<br>atgacgctcttcacatgcaggccctgccgcctcgg |
| CAR123-3 AA | 1134 | MALPVTALLLPLALLLHAARPQVQLVQSGAEVKKPGASVKVSCKASGYIFTGYYIHWVRQAP<br>GQGLEWMGWINPNSGGTNYAQKFQGRVTMTRDTSISTAYMELSGLRSDDPAVYYCARDMNIL<br>ATVPFDIWGQGTLVTVSSGGGGSGGGGSGGGGSDIQLTQSPSSLSASVGDRVTITCRASQSI<br>SSYLNWYQQKPGKAPKLLIYAASSLQSGVPSRFSGSGSGTDFTLTVNSLQPEDFATYYCQQG<br>DSVPLTFGGGTKVEIKTTTPAPRPPTPAPTIASQPLSLRPEACRPAAGGAVHTRGLDFACDI<br>YIWAPLAGTCGVLLLSLVITLYCKRGRKKLLYIFKQPFMRPVQTTQEEDGCSCRFPEEEEGG<br>CELRVKFSRSADAPAYKQGQNQLYNELNLGRREEYDVLDKRRGRDPEMGGKPRRKNPQEGLY<br>NELQKDKMAEAYSEIGMKGERRRGKGHDGLYQGLSTATKDTYDALHMQALPPR |
| CAR123-3 scFv | 1135 | MALPVTALLLPLALLLHAARPQVQLVQSGAEVKKPGASVKVSCKASGYIFTGYYIHWVRQAP<br>GQGLEWMGWINPNSGGTNYAQKFQGRVTMTRDTSISTAYMELSGLRSDDPAVYYCARDMNIL<br>ATVPFDIWGQGTLVTVSSGGGGSGGGGSGGGGSDIQLTQSPSSLSASVGDRVTITCRASQSI<br>SSYLNWYQQKPGKAPKLLIYAASSLQSGVPSRFSGSGSGTDFTLTVNSLQPEDFATYYCQQG<br>DSVPLTFGGGTKVEIK |
| CAR123-3 VH | 1136 | QVQLVQSGAEVKKPGASVKVSCKASGYIFTGYYIHWVRQAPGQGLEWMGWINPNSGGTNYAQ<br>KFQGRVTMTRDTSISTAYMELSGLRSDDPAVYYCARDMNILATVPFDIWGQGTLVTVSS |
| CAR123-3 VL | 1137 | DIQLTQSPSSLSASVGDRVTITCRASQSISSYLNWYQQKPGKAPKLLIYAASSLQSGVPSRF<br>SGSGSGTDFTLTVNSLQPEDFATYYCQQGDSVPLTFGGGTKVEIK |
| CAR123-4 NT | 1138 | atggccctccctgtcaccgccctgctgcttccgctggctcttctgctccacgccgc<br>tcggcccccaagtccaactccaacagtcaggcgcagaagtgaaaaagagcggtgcat<br>cggtgaaagtgtcatgcaaagcctcgggctacaccttcactgactactatatgcac<br>tggctcgcgcaggcaccgggacagggacttgagtggatgggatggatcaacccgaa<br>ttcaggggacactaactacgcgcagaagttccaggggagagtgaccctgacgaggg<br>acacctcaatttcgaccgtctacatggaattgtcgcgcctgagatcggacgatact<br>gctgtgtactactgtgcccgcgacatgaacatcctcgcgactgtgccttttgatat<br>ctggggacaggggactatggtcaccgtttcctccgcttccggtggcggaggctcsg<br>gaggccgggcctccggtggaggaggcagcgacatccagatgactcagagcccttcc<br>tcgctgagcgcctcagtgggagatcgcgtgaccatcacttgccgggccagccagtc<br>catttcgtcctacctcaattggtaccagcagaagccgggaaaggcgcccaagctct<br>tgatctacgctgcgagctccctgcaaagcggggtgccgagccgattctcgggttcc<br>ggctcgggaaccgacttcactctgaccatctcatccctgcaaccagaggacttgc<br>cacctactactgccaacaaggagattctgtcccactgacgttcggcggaggaacca<br>aggtcgaaatcaagaccactaccccagcaccgaggccacccacccggctcctacc<br>atcgcctcccagcctctgtccctgcgtccggaggcatgtagacccgcagctggtgg<br>ggccgtgcatacccggggtcttgacttcgcctgcgatatctacatttgggcccctc<br>tggctggtacttgcggggtcctgctgcttcactcgtgatcactcttactgtaag<br>cgcggtcggaagaagctgctgtacatctttaagcaacccttcatgaggcctgtgca<br>gactactcaagaggaggacggctgttcatgccggttcccagaggaggaggaaggcg<br>gctgcgaactgcgcgtgaaattcagccgcagcgcagatgctccagcctacaagcag<br>gggcagaaccagctctacaacgaactcaatcttggtcggagagaggagtacgacgt<br>gctggacaagcggagaggacgggacccagaaatgggcgggaagccgcgcagaaaga<br>atcccaagagggcctgtacaacgagctccaaaaggataagatggcagaagcctat<br>agcgagattggtatgaaaggggaacgcagaagaggcaaaggccacgacggactgta<br>ccagggactcagcaccgccaccaaggacacctatgacgctcttcacatgcaggccc<br>tgccgcctcgg |
| CAR123-4 AA | 1139 | MALPVTALLLPLALLLHAARPQVQLQQSGAEVKKSGASVKVSCKASGYTFTDYYMHWLRQAP<br>GQGLEWMGWINPNSGDTNYAQKFQGRVTLTRDTSISTVYMELSRLRSDDTAVYYCARDMNIL<br>ATVPFDIWGQGTMVTVSSASGGGGSGGGRASGGGGSDIQMTQSPSSLSASVGDRVTITCRASQ<br>SISSYLNWYQQKPGKAPKLLIYAASSLQSGVPSRFSGSGSGTDFTLTISSLQPEDFATYYCQ<br>QGDSVPLTFGGGTKVEIKTTTPAPRPPTPAPTIASQPLSLRPEACRPAAGGAVHTRGLDFAC<br>DIYIWAPLAGTCGVLLLSLVITLYCK |

TABLE 16-continued

Human CD123 CAR Constructs

| Name | SEQ ID | Sequence |
|---|---|---|
| CAR123-4 scFv | 1140 | MALPVTALLLPLALLLHAARPQVQLQQSGAEVKKSGASVKVSCKASGYTFTDYYMHWLRQAPGQGLEWMGWINPNSGDTNYAQKFQGRVTLTRDTSISTVYMELSRLRSDDTAVYYCARDMNILATVPFDIWGQGTMVTVSSASGGGGSGGRASGGGGSDIQMTQSPSSLSASVGDRVTITCRASQSISSYLNWYQQKPGKAPKLLIYAASSLQSGVPSRFSGSGSGTDFTLTISSLQPEDFATYYCQQGDSVPLTFGGGTKVEIK |
| CAR123-4 VH | 1141 | QVQLQQSGAEVKKSGASVKVSCKASGYTFTDYYMHWLRQAPGQGLEWMGWINPNSGDTNYAQKFQGRVTLTRDTSISTVYMELSRLRSDDTAVYYCARDMNILATVPFDIWGQGTMVTVSS |
| CAR123-4 VL | 1142 | DIQMTQSPSSLSASVGDRVTITCRASQSISSYLNWYQQKPGKAPKLLIYAASSLQSGVPSRFSGSGSGTDFTLTISSLQPEDFATYYCQQGDSVPLTFGGGTKVEIK |

In some embodiments, the antigen binding domain comprises a HC CDR1, a HC CDR2, and a HC CDR3 of any heavy chain binding domain amino acid sequences listed in Table 16. In embodiments, the antigen binding domain further comprises a LC CDR1, a LC CDR2, and a LC CDR3. In embodiments, the antigen binding domain comprises a LC CDR1, a LC CDR2, and a LC CDR3 of any light chain binding domain amino acid sequences listed in Table 16.

In some embodiments, the antigen binding domain comprises one, two or all of LC CDR1, LC CDR2, and LC CDR3 of any light chain binding domain amino acid sequences listed in Table 16, and one, two or all of HC CDR1, HC CDR2, and HC CDR3 of any heavy chain binding domain amino acid sequences listed in Table 16.

In some embodiments, the CDRs are defined according to the Kabat numbering scheme, the Chothia numbering scheme, or a combination thereof.

The sequences of human CDR sequences of the scFv domains are shown in Table 17 for the heavy chain variable domains and in Table 18 for the light chain variable domains. "ID" stands for the respective SEQ ID NO for each CDR.

TABLE 17

Heavy Chain Variable Domain CDRs

| Candidate | HCDR1 | SEQ ID NO: | HCDR2 | SEQ ID NO: | HCDR3 | SEQ ID NO: |
|---|---|---|---|---|---|---|
| CAR123-1 | GYTFTDYYMH | 1006 | WINPNSGDTNYAQKFQG | 1010 | DMNILATVPFDI | 1014 |
| CAR123-2 | GYTFTGYYMH | 1007 | WINPNSGGTNYAQKFQG | 1011 | DMNILATVPFDI | 1015 |
| CAR123-3 | GYTFTGYYMH | 1008 | WINPNSGGTNYAQKFQG | 1012 | DMNILATVPFDI | 1016 |
| CAR123-4 | GYIFTGYYIH | 1009 | WINPNSGGTNYAQKFQG | 1013 | DMNILATVPFDI | 1017 |

TABLE 18

Light Chain Variable Domain CDRs

| Candidate | LCDR1 | SEQ ID NO: | LCDR2 | SEQ ID NO: | LCDR3 | SEQ ID NO: |
|---|---|---|---|---|---|---|
| CAR123-1 | RASQSISYLN | 1018 | AASSLQS | 1022 | QQGDSVPLT | 1026 |
| CAR123-2 | RASQSISTYLN | 1019 | AAFSLQS | 1023 | QQGDSVPLT | 1027 |
| CAR123-3 | RASQSISYLN | 1020 | AASSLQS | 1024 | QQGDSVPLT | 1028 |
| CAR123-4 | RASQSISYLN | 1021 | AASSLQS | 1025 | QQGDSVPLT | 1029 |

In an embodiment, the B-cell inhibitor comprises a CD123 CAR which comprises an antibody or antibody fragment which includes a CD123 binding domain, wherein said CD123 binding domain comprises one or more of light chain complementary determining region 1 (LC CDR1), light chain complementary determining region 2 (LC CDR2), and light chain complementary determining region 3 (LC CDR3) amino acid sequence listed in Table 18, and one or more of heavy chain complementary determining region 1 (HC CDR1), heavy chain complementary determining region 2 (HC CDR2), and heavy chain complementary determining region 3 (HC CDR3) of any CD123 heavy chain binding domain amino acid sequence listed in Table 17.

Additional CD123 CDR sequences of the scFv domains are shown in Tables 19, 21, and 23 for the heavy chain variable domains and in Tables 20, 22, and 24 for the light chain variable domains. "ID" stands for the respective SEQ ID NO for each CDR.

The CDRs provided in Tables 19 and 20 are according to a combination of the Kabat and Chothia numbering scheme.

TABLE 19

Heavy Chain Variable Domain CDRs

| Candidate | HCDR1 | SEQ ID NO: | HCDR2 | SEQ ID NO: | HCDR3 | SEQ ID NO: |
|---|---|---|---|---|---|---|
| CAR123-1 | GYTFTDYYMH | 1030 | WINPNSGDTNYAQKFQG | 1034 | DMNILATVPFDI | 1038 |
| CAR123-2 | GYTFTGYYMH | 1031 | WINPNSGGTNYAQKFQG | 1035 | DMNILATVPFDI | 1039 |
| CAR123-3 | GYIFTGYYIH | 1032 | WINPNSGGTNYAQKFQG | 1036 | DMNILATVPFDI | 1040 |
| CAR123-4 | GYTFTGYYMH | 1033 | WINPNSGGTNYAQKFQG | 1037 | DMNILATVPFDI | 1041 |

TABLE 20

Light Chain Variable Domain CDRs

| Candidate | LCDR1 | SEQ ID NO: | LCDR2 | SEQ ID NO: | LCDR3 | SEQ ID NO: |
|---|---|---|---|---|---|---|
| CAR123-1 | RASQSISTYLN | 1042 | AASSLQS | 1046 | QQGDSVPLT | 1050 |
| CAR123-2 | RASQSISSYLN | 1043 | AAFSLQS | 1047 | QQGDSVPLT | 1051 |
| CAR123-3 | RASQSISSYLN | 1044 | AASSLQS | 1048 | QQGDSVPLT | 1052 |
| CAR123-4 | RASQSISSYLN | 1045 | AASSLQS | 1049 | QQGDSVPLT | 1053 |

In an embodiment, the B-cell inhibitor comprises a CD123 CAR which comprises an antibody or antibody fragment which includes a CD123 binding domain, wherein said CD123 binding domain comprises one or more of light chain complementary determining region 1 (LC CDR1), light chain complementary determining region 2 (LC CDR2), and light chain complementary determining region 3 (LC CDR3) amino acid sequence listed in Table 20, and one or more of heavy chain complementary determining region 1 (HC CDR1), heavy chain complementary determining region 2 (HC CDR2), and heavy chain complementary determining region 3 (HC CDR3) of any CD123 heavy chain binding domain amino acid sequence listed in Table 19.

TABLE 21

Heavy Chain Variable Domain CDRs according to the Kabat numbering scheme (Kabat et al. (1991), "Sequences of Proteins of Immunological Interest," 5th Ed. Public Health Service, National Institutes of Health, Bethesda, MD)

| Candidate | HCDR1 | SEQ ID NO: | HCDR2 | SEQ ID NO: | HCDR3 | SEQ ID NO: |
|---|---|---|---|---|---|---|
| CAR123-1 | GYYMH | 1054 | WINPNSGGTNYAQKFQG | 1058 | DMNILATVPFDI | 1062 |
| CAR123-2 | GYYMH | 1055 | WINPNSGGTNYAQKFQG | 1059 | DMNILATVPFDI | 1063 |
| CAR123-3 | GYYIH | 1056 | WINPNSGGTNYAQKFQG | 1060 | DMNILATVPFDI | 1064 |
| CAR123-4 | DYYMH | 1057 | WINPNSGDTNYAQKFQG | 1061 | DMNILATVPFDI | 1065 |

TABLE 22

Light Chain Variable Domain CDRs according to the Kabat numbering scheme (Kabat et al. (1991), "Sequences of Proteins of Immunological Interest," 5th Ed. Public Health Service, National Institutes of Health, Bethesda, MD)

| Candidate | LCDR1 | SEQ ID NO: | LCDR2 | SEQ ID NO: | LCDR3 | SEQ ID NO: |
|---|---|---|---|---|---|---|
| CAR123-1 | RASQSISTYLN | 1066 | AAFSLQS | 1070 | QQGDSVPLT | 1074 |
| CAR123-2 | RASQSISSYLN | 1067 | AASSLQS | 1071 | QQGDSVPLT | 1075 |
| CAR123-3 | RASQSISSYLN | 1068 | AASSLQS | 1072 | QQGDSVPLT | 1076 |
| CAR123-4 | RASQSISSYLN | 1069 | AASSLQS | 1073 | QQGDSVPLT | 1077 |

In an embodiment, the B-cell inhibitor comprises a CD123 CAR which comprises an antibody or antibody fragment which includes a CD123 binding domain, wherein said CD123 binding domain comprises one or more of light chain complementary determining region 1 (LC CDR1), light chain complementary determining region 2 (LC CDR2), and light chain complementary determining region 3 (LC CDR3) amino acid sequence listed in Table 22, and one or more of heavy chain complementary determining region 1 (HC CDR1), heavy chain complementary determining region 2 (HC CDR2), and heavy chain complementary determining region 3 (HC CDR3) of any CD123 heavy chain binding domain amino acid sequence listed in Table 21.

TABLE 23

Heavy Chain Variable Domain CDRs according to the Chothia numbering scheme (Al-Lazikani et al., (1997) JMB 273, 927-948)

| Candidate | HCDR1 | SEQ ID NO: | HCDR2 | SEQ ID NO: | HCDR3 | SEQ ID NO: |
|---|---|---|---|---|---|---|
| CAR123-1 | GYTFTGY | 1078 | NPNSGG | 1082 | DMNILATVPFDI | 1086 |
| CAR123-2 | GYTFTGY | 1079 | NPNSGG | 1083 | DMNILATVPFDI | 1087 |
| CAR123-3 | GYIFTGY | 1080 | NPNSGG | 1084 | DMNILATVPFDI | 1088 |
| CAR123-4 | GYTFTDY | 1081 | NPNSGD | 1085 | DMNILATVPFDI | 1089 |

TABLE 24

Light Chain Variable Domain CDRs according to the Chothia numbering scheme (Al-Lazikani et al., (1997) JMB 273, 927-948)

| Candidate | LCDR1 | SEQ ID NO: | LCDR2 | SEQ ID NO: | LCDR3 | SEQ ID NO: |
|---|---|---|---|---|---|---|
| CAR123-1 | SQSISTY | 1090 | AAF | 1094 | GDSVPL | 1098 |
| CAR123-2 | SQSISSY | 1091 | AAS | 1095 | GDSVPL | 1099 |
| CAR123-3 | SQSISSY | 1092 | AAS | 1096 | GDSVPL | 1100 |
| CAR123-4 | SQSISSY | 1093 | AAS | 1097 | GDSVPL | 1101 |

In an embodiment, the B-cell inhibitor comprises a CD123 CAR which comprises an antibody or antibody fragment which includes a CD123 binding domain, wherein said CD123 binding domain comprises one or more of light chain complementary determining region 1 (LC CDR1), light chain complementary determining region 2 (LC CDR2), and light chain complementary determining region 3 (LC CDR3) amino acid sequence listed in Table 24, and one or more of heavy chain complementary determining region 1 (HC CDR1), heavy chain complementary determining region 2 (HC CDR2), and heavy chain complementary determining region 3 (HC CDR3) of any CD123 heavy chain binding domain amino acid sequence listed in Table 23.

Additional description of these CD123 CARs is provided, for instance, in PCT/CN2014/090508, which application incorporated by reference herein in its entirety.

Figure 41:
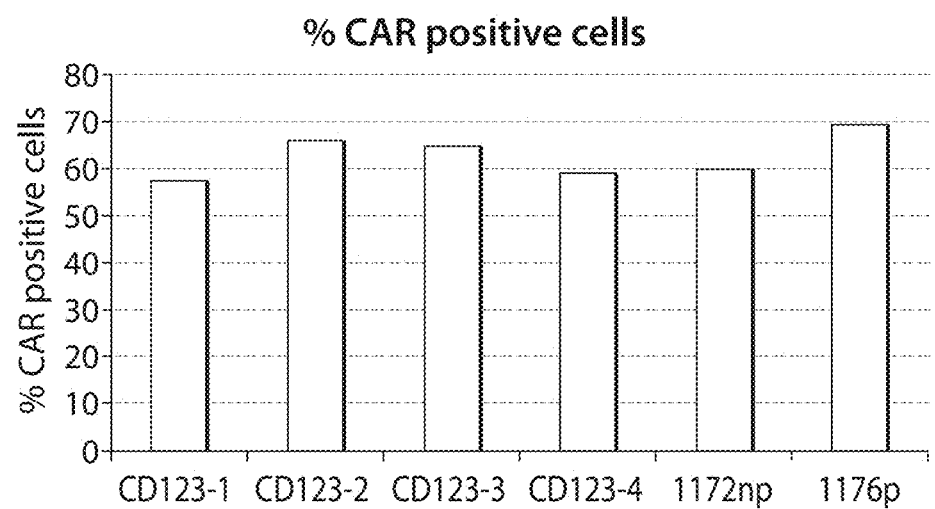
FIG. 41 shows a graphical representation of CAR expression in JNL cells transduced with anti-CD123 CAR constructs as evaluated by FACS and reported as the percent of cells showing signal above the level of signal in untransduced (CAR negative) cells using Protein L as a detection reagent.
Figure 42A:
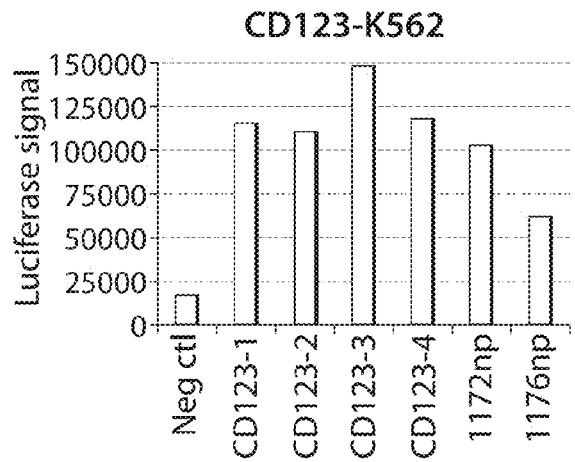
FIGS. 42A, 42B, and 42C show graphical representations of CD123 CAR activity in JNL cells. Anti-CD123 CAR constructs were evaluated for activity using a Jurkat cell line containing the luciferase reporter driven by the NFAT promoter (termed JNL cells). CAR activity is measured as activation of this NFAT-driven reporter.
Figure 42B:
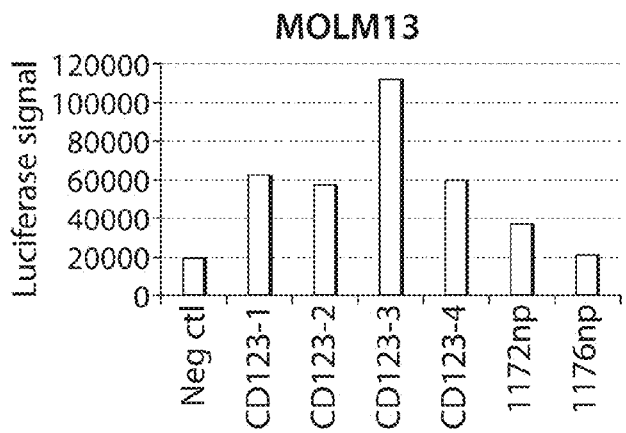
Figure 42C:
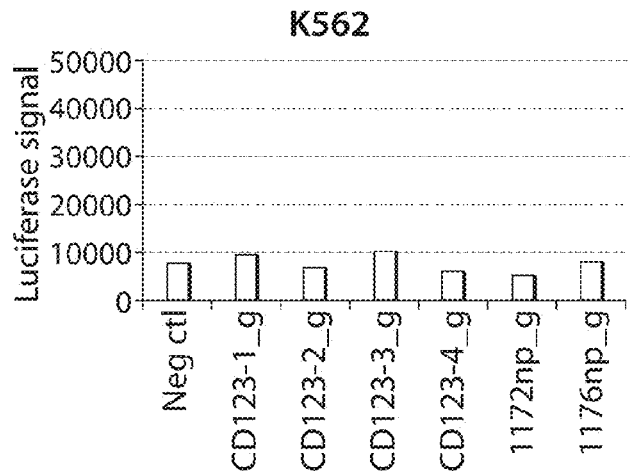

Human anti-CD123 CAR constructs were evaluated for activity using a Jurkat cell line containing the luciferase reporter driven by the NFAT promoter (termed JNL cells). CD123 CAR activity was measured for four human CAR constructs described herein (CD123 CAR1-4) and murine CD123 CAR constructs 1172 and 1176. CAR activity was measured as activation of this NFAT-driven reporter. Lentiviral supernatants containing the CART constructs were added to JNL cells for transduction. 4-6 days after transduction, JNL cells were either evaluated for CAR expression by FACS as described below or mixed with target-positive (MOLM3, K562 cells engineered to express CD123 (CD123-K562)) or target-negative (K562) cell lines at an effector (JNL) to target cell line (E:T) ratio of 3:1 to trigger activation (FIG. 41). After 20 hours of co-incubation, luciferase signal was measured using the Bright-Glo™ Luciferase Assay on the EnVision instrument as shown in FIGS. 42A, 42B and 42C.

Optimal anti-CD123 CAR constructs were selected based on the quantity and quality of the effector T cell responses of CD123 CAR transduced T cells ("CART-CD123" or "CART-CD123 T cells") in response to CD123 expressing ("CD123+") targets. Effector T cell responses include, but are not limited to, cellular expansion, proliferation, doubling, cytokine production and target cell killing or cytolytic activity (degranulation).

Generation of CART-CD123

The human scFv encoding lentiviral transfer vectors were used to produce the genomic material packaged into the VSVg pseudotyped lentiviral particles. Lentiviral transfer vector DNA was mixed with the three packaging components of VSVg, gag/pol and rev in combination with lipofectamine reagent to transfect them together in to Lenti-X 293T cells (Clontech).

After 30 hours, the media was collected, filtered and stored at −80 C. The therapeutic CART-CD123 were generated by starting with the blood from a normal apheresed donor whose naïve T cells were obtained by negative selection for T cells, CD4+ and CD8+ lymphocytes. These cells were activated by CD3x28 beads (Dynabeads® Human T-Expander CD3/CD28, Invitrogen) at a ratio of 1:3 in RPMI 1640, 10% heat-inactivated fetal calf serum (FCS), 2 mM L-glutamine, 1x Penicillin/Streptomycin, 100 µM non-essential amino acids, 1 mM NaPyruvate, 10 mM Hepes, and 55 µM 2-mercaptoethanol at 37° C., 5% $CO_2$. T cells were cultured at $1\times10^6$ T cells in 0.5 mL medium per well of a 24-well plate. After 24 hours, the T cells was blasting and 0.5 mL of viral supernatant was added. The T cells then began to divide in a logarithmic growth pattern, which was monitored by measuring the cell counts per mL, and T cells were diluted in fresh medium every two days. As the T cells began to rest down after approximately 10 days, the logarithmic growth waned. The combination of slowing growth rate and T cell size approaching ~300 fl determined the state for T cells to be cryopreserved for later analysis.

Before cryopreserving, percentage of cells transduced (expressing the anti-CD123 CAR on the cell surface) and their relative fluorescence intensity of expression were determined by flow cytometric analysis on a BD LSR-Fortessa or BD-FACSCanto using Protein L as a detection reagent. Gating histogram plots of relative fluorescent intensity from that FACS for signal above unstained cells demonstrated the percentage of transduced T cells. Transduction resulted in a range of CART positive cells from 12-42% as shown in FIGS. 42A, 42B and 42C.

Evaluating Cytolytic Activity of CART-CD123 Redirected T Cells.

To evaluate the functional abilities of CART-CD123 T cells to kill target expressing cells, the cells were thawed and allowed to recover overnight.

Figure 43A:
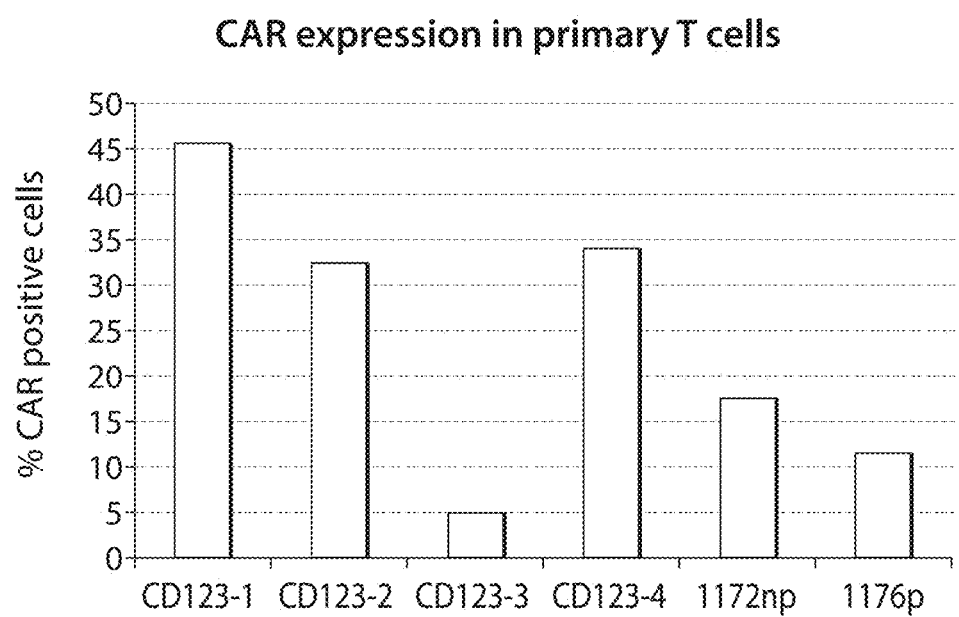
FIGS. 43A and 43B show CD123 expressing and activity.
Figure 43B:
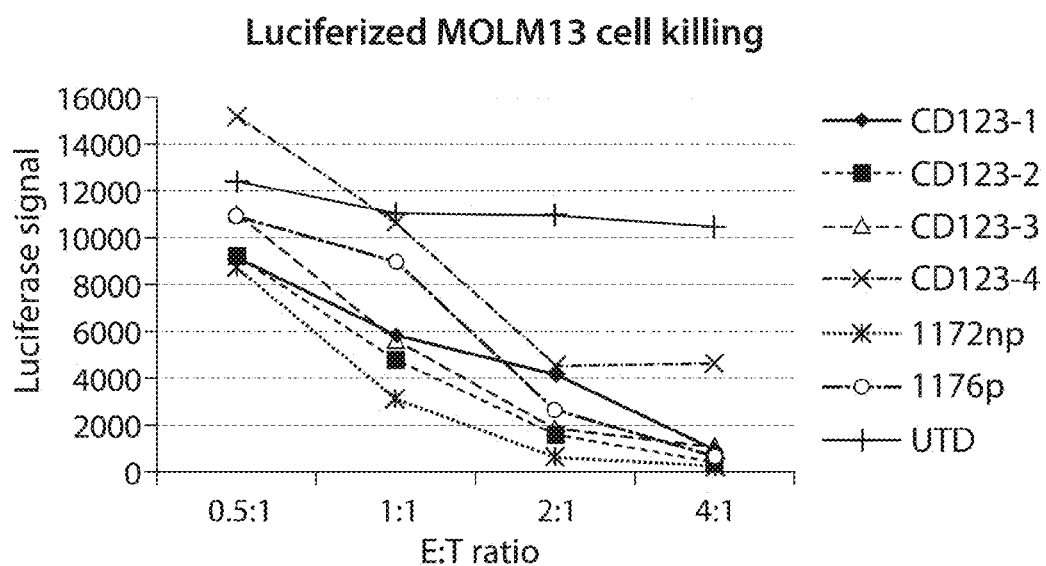

T cell killing was directed towards CD123-expressing MOLM13 acute myelogenous leukemia cell lines stably expressing luciferase. Untransduced T cells were used to determine non-specific background killing levels. The cytolytic activities of CART-CD123 were measured as a titration of effector:target cell ratios of 4:1 and 2-fold downward dilutions of T cells where effectors were defined as T cells expressing the anti-CD123 chimeric receptor. Assays were initiated by mixing an appropriate number of T cells with a constant number of targets cells. After 20 hours luciferase signal was measured using the Bright-Glo™ Luciferase Assay on the EnVision instrument. As the proportion of CD123-CART-expressing cells to untransduced T cells was increased, killing of CD123 cells was similarly increased. The data presented herein suggest that those cells expressing CD123 are destroyed only by CD123-CART-expressing cells and not by untransduced T cells. FIGS. 43A and 43B.

T Cell Transduction

Human anti-human CD123 clones NVS 2 (expressing CAR123-2), NVS 3 (expressing CAR123-3), NVS 4 (expressing CAR123-4) were selected for further study. These clones were all cross-reactive against cynomolgus CD123. Their activity was compared against mouse clones 1172 and 1176, comprising the VH and VL domains in a light-to-heavy orientation with a CD8 hinge domain, CD8 transmembrane domain, and 41BB-costimulatory domain. 1176 is also cross-reactive against cynomolgus CD123. 1172 is not.

Plasmids were transformed into competent cells, grown in 500 cc broth, isolated by maxiprep, and transduced using standard methods into 293T cells. Lentiviral supernatant was collected at 24 and 48 hours, concentrated using ultra-centrifugation, and frozen.

The lentivirus was titered on SupT1 cells and the appropriate amount of virus was determined for a transduction of primary T cells at a MOI of 3. Primary normal donor CD4+CD8 cells were stimulated using anti-CD3/CD28 beads (Dynal, Invitrogen) and interleukin-2 100 U/ml for 6 days, followed by debeading and were and frozen once. The T cell cellular volume decreased to <300 fL (after approximately 10-12 days).

Figure 44A:
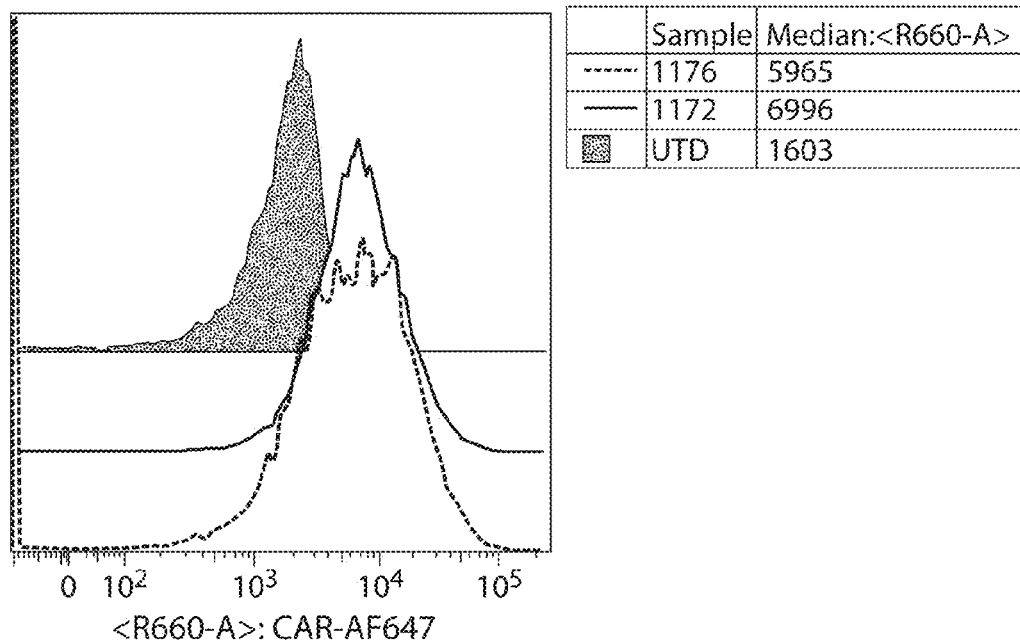
FIGS. 44A and 44B show transduction efficiency of T cells with CD123-CARs.
Figure 44B:
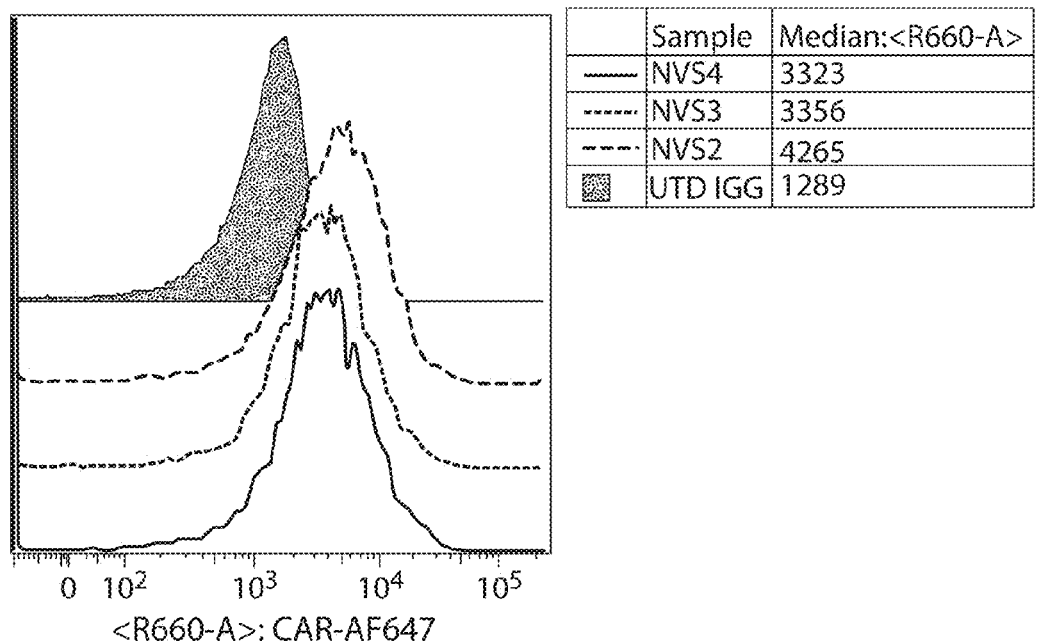
Figure 45:
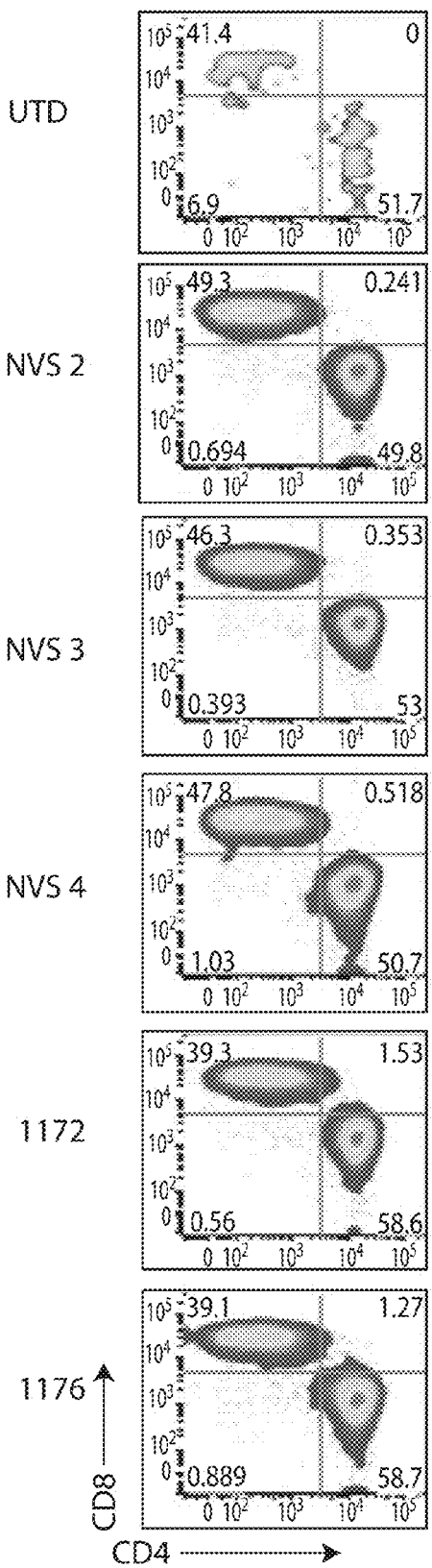
FIG. 45 shows flow cytometry of CD123 CARs 2-4 and 1172 and 1176 to determine the CD4:CD8 ratio.

T cell transduction efficiency was virtually 100% for all clones (FIGS. 44A and 44B). CD4:CD8 ratios were approximately 1:1 in the NVS clones, and 3:2 in the 1172 and 1176 clones (FIG. 45).

Degranulation

To assess degranulation, CART cells (NVS 2-4, 1172 and 1176 clones) were thawed, rested overnight at a concentration of $2e^6$ cells/ml in T cell media. Cells were then counted and resuspended at $1e^6$ cells/ml the following day. Tumor target cells (TCM, PMA/iono, MOLM14 or JURKAT) were resuspended at $5e^6$ cells/ml. Cells were plated at a ratio of $1e^5$ T cell:$5e^5$ tumor cell in 48 well plates and incubated for 2 hours in the presence of anti-CD107a PECy7, anti-CD49d purified, and anti-CD28 purified antibodies. Cells were then harvested, stained with anti-CD3 APC and acquired using BD LSR Fortessa (FIGS. 46A, 46B and 46C).

Figure 46A:
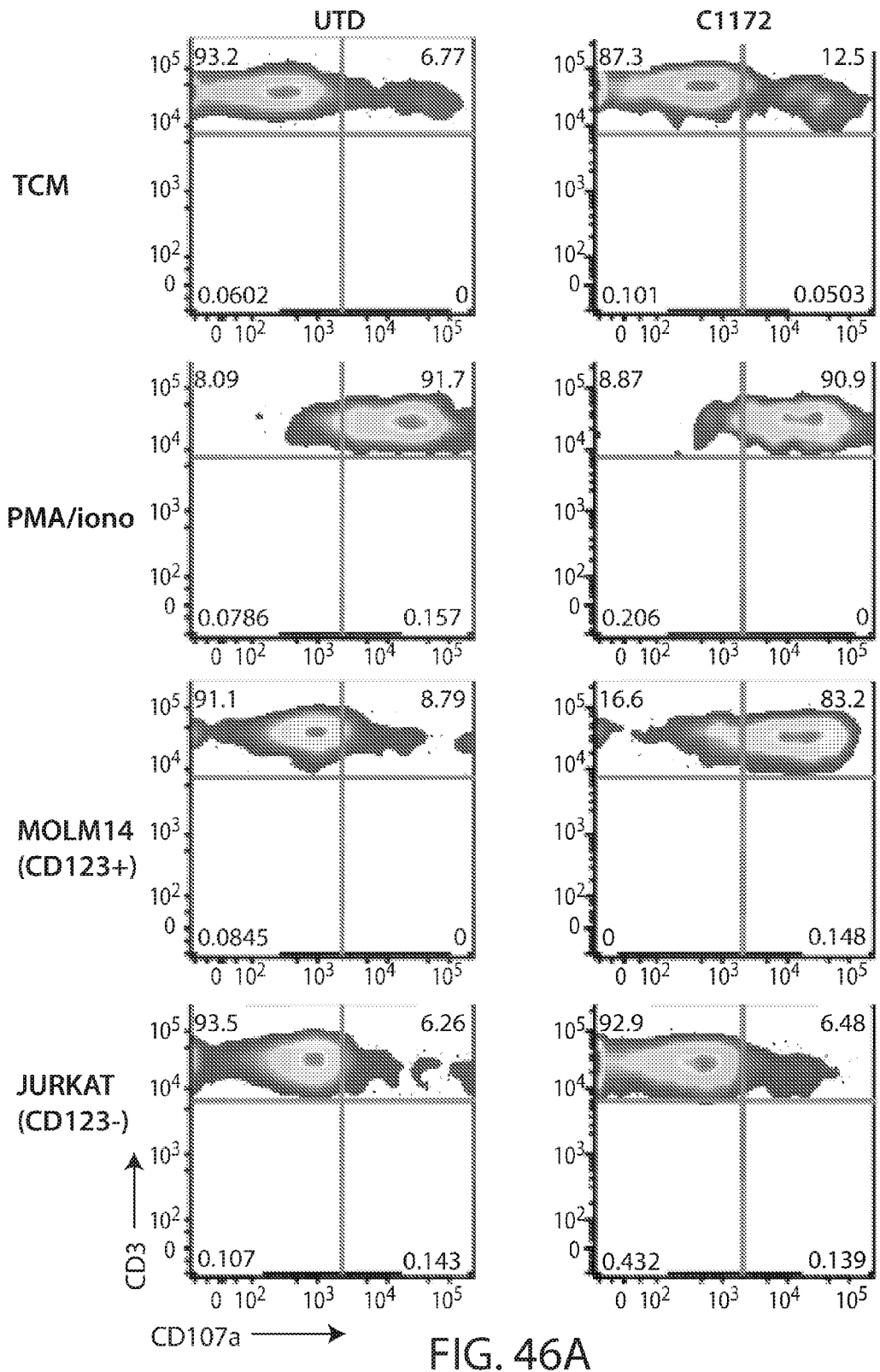
FIGS. 46A, 46B and 46C show degranulation of CD123 CARs 2-4 and 1172 and 1176 upon exposure to CD123+ tumor cells.
Figure 46B:
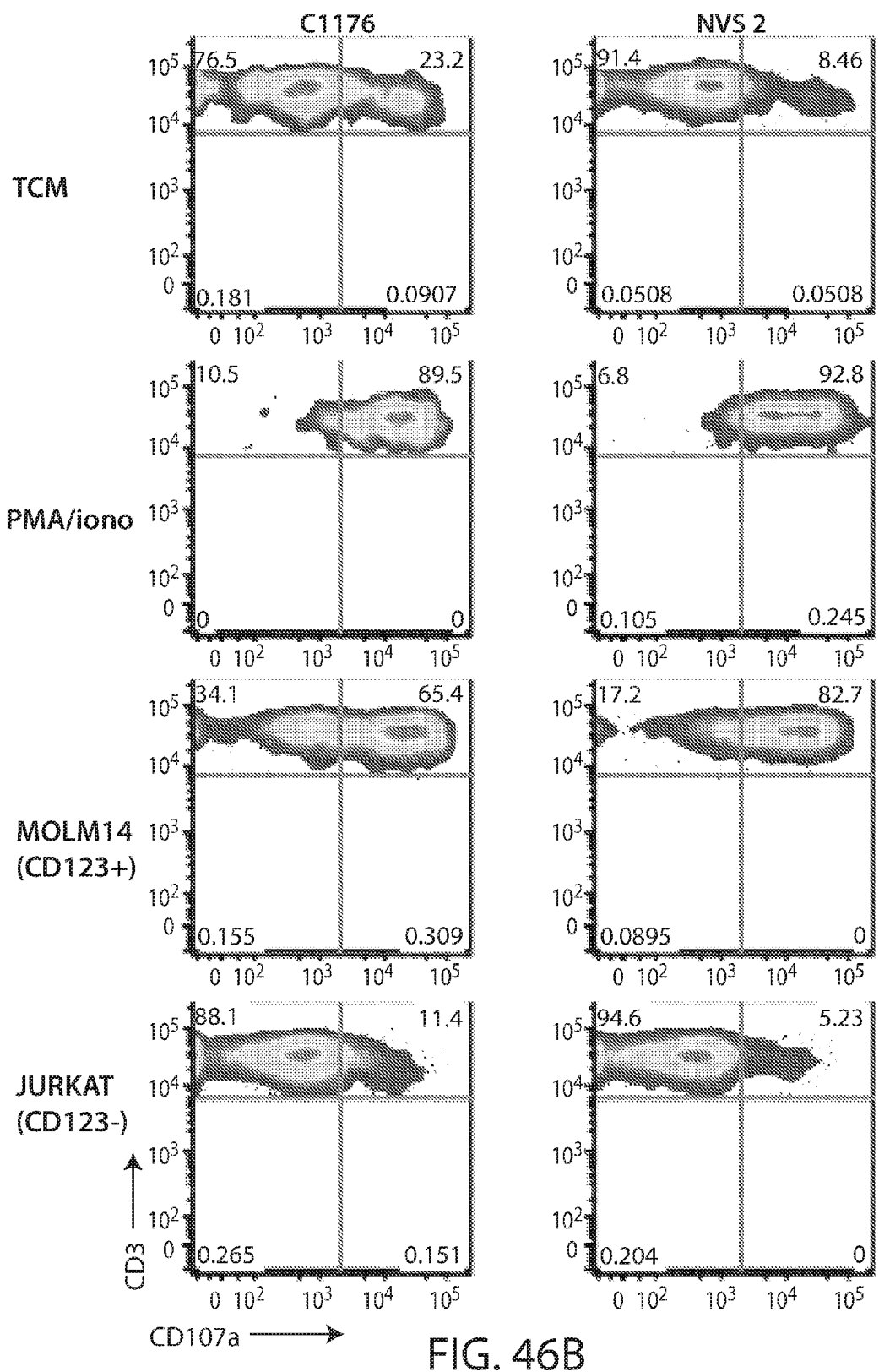
Figure 46C:
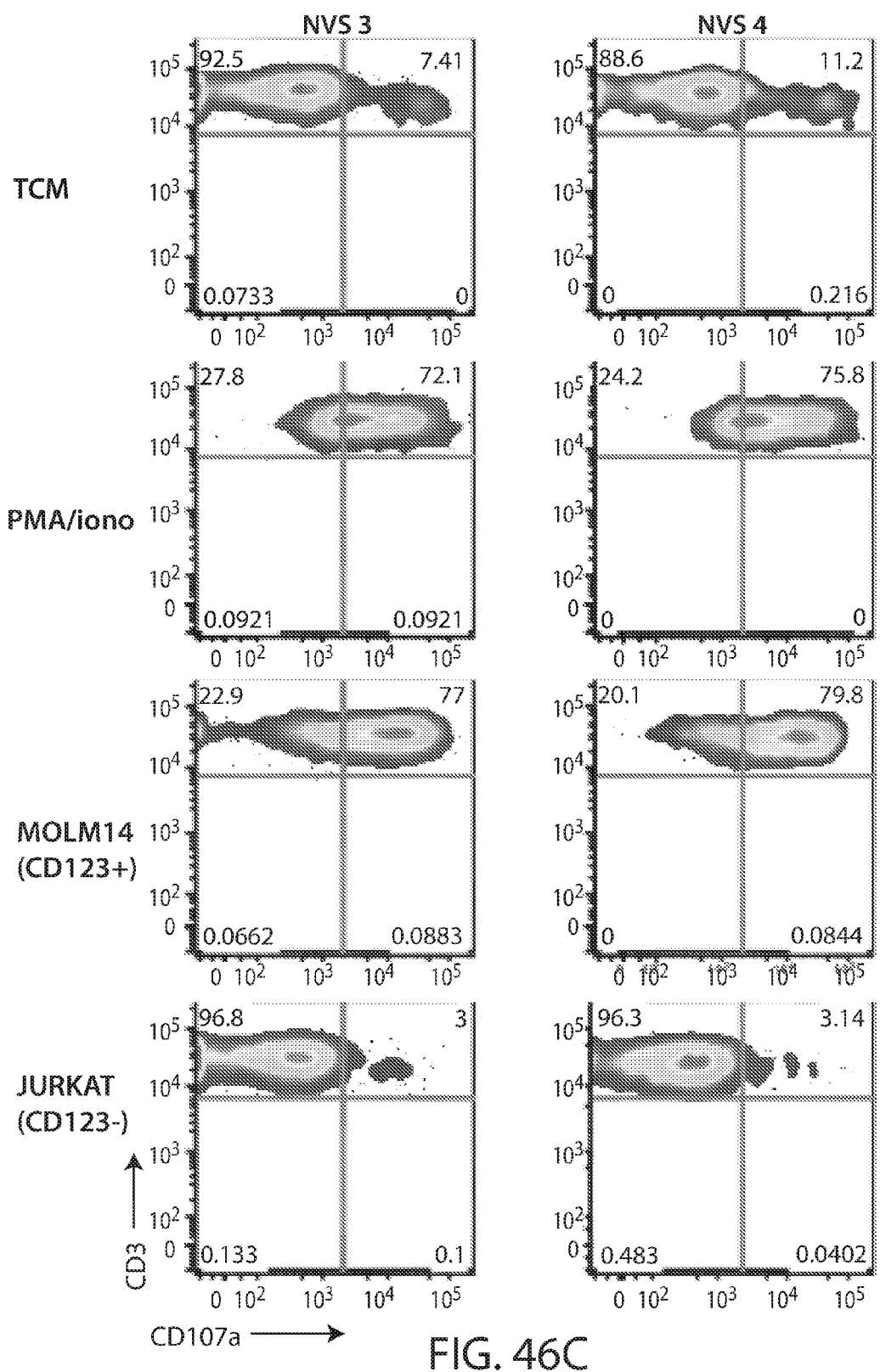

T cell degranulation is indicated in the upper right quadrant of each plot of FIGS. 46A, 46B and 46C. The results presented herein demonstrate similar T cell recognition of CD123+ targets, manifested by similar degranulation during a 2-hr in vitro assay. C1176 had inferior degranulation of 65% compared with approximately 80% in the other clones.

Cytotoxicity

Figure 47:
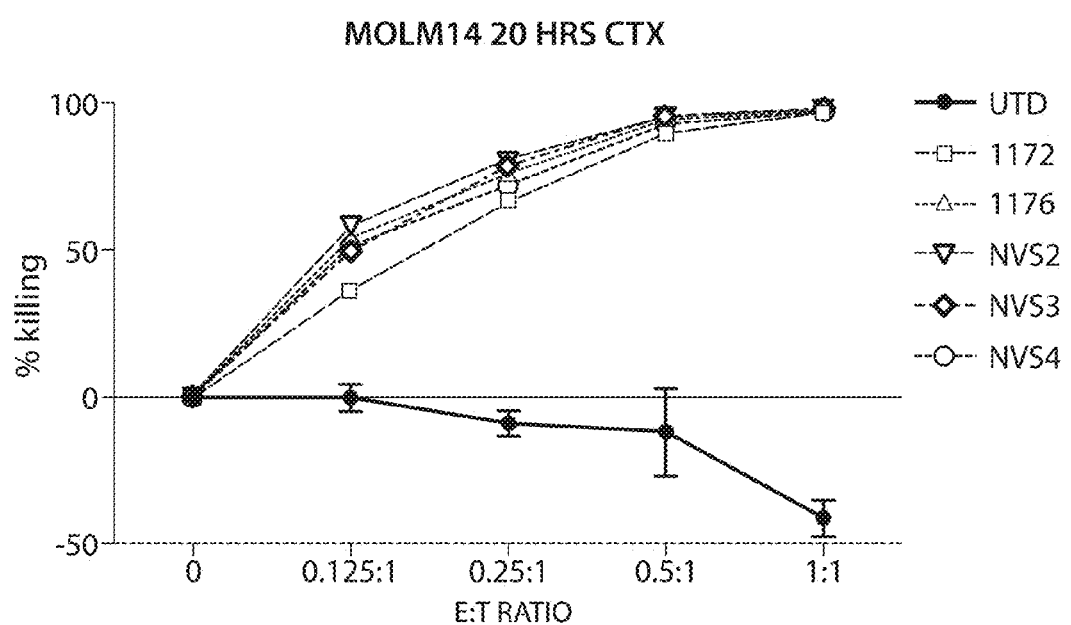
FIG. 47 shows a graphical representation of a luciferase assay to assess cytotoxicity of CART cells (NVS 2-4, 1172 and 1176 clones) towards tumor target cells (MOLM14).

To assess cytotoxicity, CART cells (NVS 2-4, 1172 and 1176 clones) were thawed and rested overnight at $2e^6$ cells/ml in T cell media. Cells were counted and resuspended at $1e^6$ cells/ml the following day. Tumor target cells (MOLM14) were resuspended at $1e^6$ cells/ml. Cells were plated in a black, flat-bottom 96 well plate at decreasing E:T ratios as indicated (FIG. 47), in duplicate. After 20 hours of incubation, luciferin was added and the plate was imaged to determine photon flux as a measure of residual live cells. Killing of MOLM14 cells was equivalent between all clones at most effector:target ratios at 20 hours.

In Vivo Mouse Model

Figure 48:
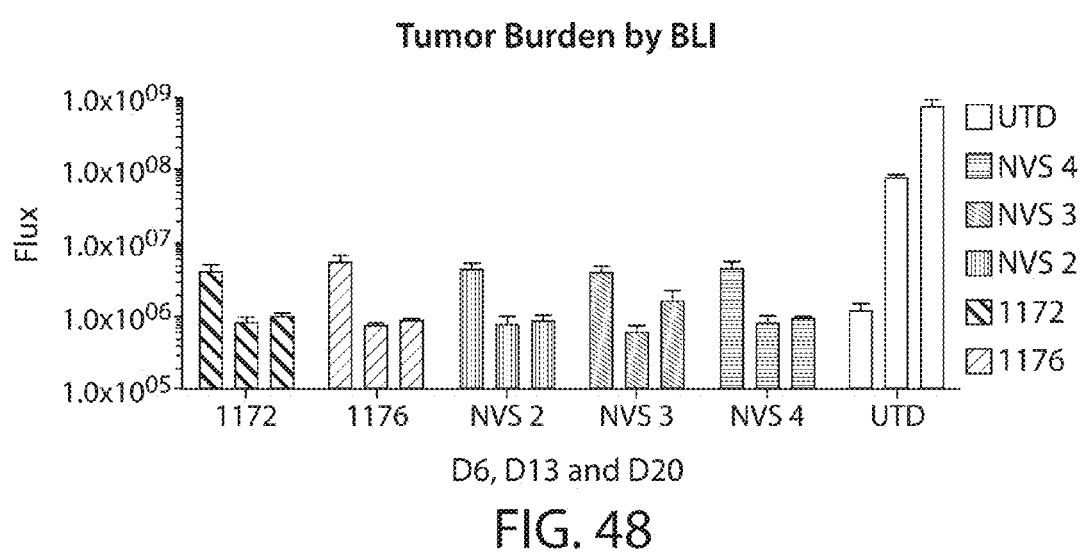
FIG. 48 shows a comparison of tumor burden in NSG mice injected with luciferase expressing MOLM14 cells at D6 (before CART injection) and at day 13 (6 days post injection with NVS 2-4, 1172 or 1176 clones) or at day 20.

NSG mice were injected iv with $1e^6$ luciferase expressing MOLM14 cells on D0. On D6 mice were imaged (IVIS Spectrum) for tumor burden and randomized into treatment groups. Mice with the lowest tumor burden were assigned to the control group (untransduced T cells, UTD). CART cells (NVS 2-4, 1172 and 1176 clones) or control T cells ($1e6$) were injected i.v. on D7. Data from imaging on performed D13 is shown in FIG. 48. Six days after injection, all anti-CD123 constructs provided equal anti-tumor effect, consistent with in vitro data.

Humanized anti-CD123 single chain variable fragments (scFv) based on murine 1176 which is cross-reactive against cynomolgus CD123 are generated and cloned into a lentiviral expression vector with the intracellular CD3zeta chain and the intracellular co-stimulatory domain of 4-1BB.

The order in which the VL and VH domains appear in the scFv was varied (i.e., VL-VH, or VH-VL orientation), and where either three or four copies of the "G45" (SEQ ID NO:18) subunit, in which each subunit comprises the sequence GGGGS (SEQ ID NO:18) (e.g., $(G4S)_3$ (SEQ ID NO:107) or $(G4S)_4$(SEQ ID NO:106)), connect the variable domains to create the entirety of the scFv domain, as shown in Table 25.

The sequences of the humanized CARs are provided below in Table 25.

These clones all contained a Q/K residue change in the signal domain of the co-stimulatory domain derived from CD3zeta chain.

TABLE 25

Humanized CD123 CAR Constructs

| Name | SEQ ID | Sequence |
|---|---|---|
| hzCAR123-1 NT | 1143 | ATGGCCCTCCCTGTCACCGCCCTGCTGCTTCCGCTGGCTCTTCTGCTCCACGCCGC<br>TCGGCCCCAAGTGCAGCTGGTCCAGTCGGGAGCCGAAGTCAAGAAGCCCGGCGCTA<br>GCGTGAAAGTGTCCTGCAAAGCCTCCGGGTACACATTCACCTCCTACTGGATGAAT<br>TGGGTCAGACAGGCGCCCGGCCAGGGACTCGAGTGGATGGGAAGGATTGATCCTTA<br>CGACTCCGAAACCCATTACAACCAGAAGTTCAAGGACCGCGTGACCATGACTGTGG<br>ATAAGTCCACTTCCACCGCTTACATGGAGCTGTCCAGCCTGCGCTCCGAGGATACC<br>GCAGTGTACTACTGCGCCCGGGGAAACTGGGACGACTATTGGGGACAGGGAACTAC<br>CGTGACCGTGTCAAGCGGGGGTGGCGGTAGCGGAGGAGGGGGCTCCGGCGGCGGCG<br>GCTCAGGGGGCGGAGGAAGCGACGTGCAGCTCACCCAGTCGCCCTCATTTCTGTCG<br>GCCTCAGTGGGAGACAGAGTGACCATTACTTGTCGGGCCTCCAAGAGCATCTCCAA<br>GGACCTGGCCTGGTATCAGCAGAAGCCAGGAAAGGCGCCTAAGTTGCTCATCTACT<br>CGGGGTCGACCCTGCAATCTGGCGTGCCGTCCCGGTTCTCCGGTTCGGGAAGCGGT<br>ACCGAATTCACCCTTACTATCTCCTCCCTGCAACCGGAGGACTTCGCCACCTACTA<br>CTGCCAACAGCACAACAAGTACCCGTACACTTTCGGGGGTGGCACGAAGGTCGAAA<br>TCAAGACCACTACCCCAGCACCGAGGCCACCCACCCCGGCTCCTACCATCGCCTCC<br>CAGCCTCTGTCCCTGCGTCCGGAggcatgtagacccgcagctggtggggccgtgca<br>tacccggggtcttgacttcgcctgcgatatctacatttgggcccctctggctggta<br>cttgcggggtcctgctgctttcactcgtgatcactctttactgtaagcgcggtcgg |

TABLE 25-continued

Humanized CD123 CAR Constructs

| Name | SEQ ID | Sequence |
|---|---|---|
| | | aagaagctgctgtacatctttaagcaacccttcatgaggcctgtgcagactactca<br>agaggaggacggctgttcatgccggttcccagaggaggaggaaggcggctgcgaac<br>tgcgcgtgaaattcagccgcagcgcagatgctccagcctacaagcaggggcagaa<br>cagctctacaacgaactcaatcttggtcggagagaggagtacgacgtgctggacaa<br>gcggagaggacgggacccagaaatgggcgggaagccgcgcagaaagaatccccaag<br>agggcctgtacaacgagctccaaaaggataagatggcagaagcctatagcgagatt<br>ggtatgaaagggaacgcagaagaggcaaaggccacgacggactgtaccagggact<br>cagcaccgccaccaaggacacctatgacgctcttcacatgcaggccctgccgcctc<br>gg |
| hzCAR123-1 AA | 1144 | MALPVTALLLPLALLLHAARPQVQLVQSGAEVKKPGASVKVSCKASGYTFTSYWMN<br>WVRQAPGQGLEWMGRIDPYDSETHYNQKFKDRVTMTVDKSTSTAYMELSSLRSEDT<br>AVYYCARGNWDDYWGQGTTVTVSSGGGGSGGGGSGGGGSGGGGSDVQLTQSPSFLS<br>ASVGDRVTITCRASKSISKDLAWYQQKPGKAPKLLIYSGSTLQSGVPSRFSGSGSG<br>TEFTLTISSLQPEDFATYYCQQHNKYPYTFGGGTKVEIKTTTPAPRPPTPAPTIAS<br>QPLSLRPEACRPAAGGAVHTRGLDFACDIYIWAPLAGTCGVLLLSLVITLYCKRGR<br>KKLLYIFKQPFMRPVQTTQEEDGCSCRFPEEEEGGCELRVKFSRSADAPAYKQGQN<br>QLYNELNLGRREEYDVLDKRRGRDPEMGGKPRRKNPQEGLYNELQKDKMAEAYSEI<br>GMKGERRRGKGHDGLYQGLSTATKDTYDALHMQALPPR |
| hzCAR123-1 scFv | 1145 | MALPVTALLLPLALLLHAARPQVQLVQSGAEVKKPGASVKVSCKASGYTFTSYWMNWVRQAP<br>GQGLEWMGRIDPYDSETHYNQKFKDRVTMTVDKSTSTAYMELSSLRSEDTAVYYCARGNWDD<br>YWGQGTTVTVSSGGGGSGGGGSGGGGSGGGGSDVQLTQSPSFLSASVGDRVTITCRASKSIS<br>KDLAWYQQKPGKAPKLLIYSGSTLQSGVPSRFSGSGSGTEFTLTISSLQPEDFATYYCQQHN<br>KYPYTFGGGTKVEIK |
| hzCAR123-1 VH | 1146 | QVQLVQSGAEVKKPGASVKVSCKASGYTFTSYWMNWVRQAPGQGLEWMGRIDPYDSETHYNQ<br>KFKDRVTMTVDKSTSTAYMELSSLRSEDTAVYYCARGNWDDYWGQGTTVTVSS |
| hzCAR123-1 VL | 1147 | DVQLTQSPSFLSASVGDRVTITCRASKSISKDLAWYQQKPGKAPKLLIYSGSTLQSGVPSRF<br>SGSGSGTEFTLTISSLQPEDFATYYCQQHNKYPYTFGGGTKVEIK |
| hzCAR123-2 NT | 1148 | ATGGCCCTCCCTGTCACCGCCCTGCTGCTTCCGCTGGCTCTTCTGCTCCACGCCGC<br>TCGGCCCCAAGTGCAGCTGGTCCAGTCGGGAGCCGAAGTCAAGAAGCCCGGCGCTA<br>GCGTGAAAGTGTCCTGCAAAGCCTCCGGGTACACATTCACCTCCTACTGGATGAAT<br>TGGGTCAGACAGGCGCCCGGCCAGGGACTCGAGTGGATGGGAAGGATTGATCCTTA<br>CGACTCCGAAACCCATTACAACCAGAAGTTCAAGGACCGCGTGACCATGACTGTGG<br>ATAAGTCCACTTCCACCGCTTACATGGAGCTGTCCAGCCTGCGCTCCGAGGATACC<br>GCAGTGTACTACTGCGCCCGGGGAAACTGGACGACTATTGGGACAGGGAACTAC<br>CGTGACCGTGTCAAGCGGGGTGGCGGTAGCGGAGGAGGGGCTCCGGCGGCGGCG<br>GCTCAGGGGGCGAGGAAGCGAAGTGGTGCTGACCCAGTCGCCCGCAACCCTCTCT<br>CTGTCGCCGGGAGAACGCGCCACTCTTTCCTGTCGGGCGTCCAAGAGCATCTCAAA<br>GGACCTCGCCTGGTACCAGCAGAAGCCTGGTCAAGCCCCGCGGCTGCTGATCTACT<br>CCGGCTCCACGCTGCAATCAGGAATCCCAGCCAGATTTTCCGGTTCGGGGTCGGGG<br>ACTGACTTCACCTTGACCATTAGCTCGCTGGAACCTGAGGACTTCGCCGTGTATTA<br>CTGCCAGCAGCACAACAAGTACCCGTACACCTTCGGAGGCGGTACTAAGGTCGAGA<br>TCAAGACCACTACCCCAGCACCGAGGCCACCCACCCCGGCTCCTACCATCGCCTCC<br>CAGCCTCTGTCCCTGCGTCCGGAggcatgtagacccgcagctggtggggccgtgca<br>tacccggggtcttgacttcgcctgcgatatctacatttgggcccctctggctggta<br>cttgcggggtcctgctgcttttcactcgtgatcactctttactgtaagcgcggtcgg<br>aagaagctgctgtacatctttaagcaacccttcatgaggcctgtgcagactactca<br>agaggaggacggctgttcatgccggttcccagaggaggaggaaggcggctgcgaac<br>tgcgcgtgaaattcagccgcagcgcagatgctccagcctacaagcaggggcagaa<br>cagctctacaacgaactcaatcttggtcggagagaggagtacgacgtgctggacaa<br>gcggagaggacgggacccagaaatgggcgggaagccgcgcagaaagaatccccaag<br>agggcctgtacaacgagctccaaaaggataagatggcagaagcctatagcgagatt<br>ggtatgaaagggaacgcagaagaggcaaaggccacgacggactgtaccagggact<br>cagcaccgccaccaaggacacctatgacgctcttcacatgcaggccctgccgcctc<br>gg |
| hzCAR123-2 AA | 1149 | MALPVTALLLPLALLLHAARPQVQLVQSGAEVKKPGASVKVSCKASGYTFTSYWMNWVRQ<br>APGQGLEWMGRIDPYDSETHYNQKFKDRVTMTVDKSTSTAYMELSSLRSEDTAVYYCARG<br>NWDDYWGQGTTVTVSSGGGGSGGGGSGGGGSGGGGSEVVLTQSPATLSLSPGERATLSCR<br>ASKSISKDLAWYQQKPGQAPRLLIYSGSTLQSGIPARFSGSGSGTDFTLTISSLEPEDFA<br>VYYCQQHNKYPYTFGGGTKVEIKTTTPAPRPPTPAPTIASQPLSLRPEACRPAAGGAVHT<br>RGLDFACDIYIWAPLAGTCGVLLLSLVITLYCKRGRKKLLYIFKQPFMRPVQTTQEEDGC<br>SCRFPEEEEGGCELRVKFSRSADAPAYKQGQNQLYNELNLGRREEYDVLDKRRGRDPEMG<br>GKPRRKNPQEGLYNELQKDKMAEAYSEIGMKGERRRGKGHDGLYQGLSTATKDTYDALHM<br>QALPPR |
| hzCAR123-2 scFv | 1150 | MALPVTALLLPLALLLHAARPQVQLVQSGAEVKKPGASVKVSCKASGYTFTSYWMNWVRQ<br>APGQGLEWMGRIDPYDSETHYNQKFKDRVTMTVDKSTSTAYMELSSLRSEDTAVYYCARG<br>NWDDYWGQGTTVTVSSGGGGSGGGGSGGGGSGGGGSEVVLTQSPATLSLSPGERATLSCR<br>ASKSISKDLAWYQQKPGQAPRLLIYSGSTLQSGIPARFSGSGSGTDFTLTISSLEPEDFA<br>VYYCQQHNKYPYTFGGGTKVEIK |

TABLE 25-continued

Humanized CD123 CAR Constructs

| Name | SEQ ID | Sequence |
|---|---|---|
| hzCAR123-2 VH | 1151 | QVQLVQSGAEVKKPGASVKVSCKASGYTFTSYWMNWVRQAPGQGLEWMGRIDPYDSETHYNQ KFKDRVTMTVDKSTSTAYMELSSLRSEDTAVYYCARGNWDDYWGQGTTVTVSS |
| hzCAR123-2 VL | 1152 | EVVLTQSPATLSLSPGERATLSCRASKSISKDLAWYQQKPGQAPRLLIYSGSTLQSGIPARF SGSGSGTDFTLTISSLEPEDFAVYYCQQHNKYPYTFGGGTKVEIK |
| hzCAR123-3 NT | 1153 | ATGGCCCTCCCTGTCACCGCCCTGCTGCTTCCGCTGGCTCTTCTGCTCCACGCCGCTCGGCC CCAAGTGCAGCTGGTCCAGTCGGGAGCCGAAGTCAAGAAGCCCGGCGCTAGCGTGAAAGTGT CCTGCAAAGCCTCCGGGTACACATTCACCTCCTACTGGATGAATTGGGTCAGACAGGCGCCC GGCCAGGGACTCGAGTGGATGGGAAGGATTGATCCTTACGACTCCGAAACCCATTACAACCA GAAGTTCAAGGACCGCGTGACCATGACTGTGGATAAGTCCACTTCCACCGCTTACATGGAGC TGTCCAGCCTGCGCTCCGAGGATACCGCAGTGTACTACTGCGCCCGGGGAAACTGGGACGAC TATTGGGGACAGGGAACTACCGTGACCGTGTCAAGCGGGGGTGGCGGTAGCGGAGGAGGGGG CTCCGGCGGCGGCGGCTCAGGGGGCGGAGGAAGCGACGTCGTGATGACCCAGTCACCGGCAT TCCTGTCCGTGACTCCCGGAGAAAAGGTCACGATTACTTGCCGGGCGTCCAAGAGCATCTCC AAGGACCTCGCCTGGTACCAACAGAAGCCGGACCAGGCCCCTAAGCTGTTGATCTACTCGGG GTCCACCCTTCAATCGGGAGTGCCATCGCGGTTTAGCGGTTCGGGTTCTGGGACCGACTTCA CTTTCACCATCTCCTCACTGGAAGCCGAGGATGCCGCCACTTACTACTGTCAGCAGCACAAC AAGTATCCGTACACCTTCGGAGGCGGTACCAAAGTGGAGATCAAGACCACTACCCCAGCACC GAGGCCACCCACCCCGGCTCCTACCATCGCCTCCCAGCCTCTGTCCCTGCGTCCGGAggcat gtagacccgcagctggtggggccgtgcataccggggtcttgacttcgcctgcgatatctac atttgggcccctctggctggtacttgcggggtcctgctgctttcactcgtgatcactcttta ctgtaagcgcggtcggaagaagctgctgtacatcttttaagcaaccccttcatgaggcctgtgc agactactcaagaggaggacggctgttcatgccggttcccagaggaggaggaaggcggctgc gaactgcgcgtgaaattcagccgcagcgcagatgctccagcctacaagcaggggcagaacca gctctacaacgaactcaatcttggtcggagagaggagtacgacgtgctggacaagcggagag gacgggacccagaaatgggcgggaagccgcgcagaaagaatccccaagagggcctgtacaac gagctccaaaggataagatggcagaagcctatagcgagattggtatgaaggggaacgcag aagaggcaaaggccacgacggactgtaccagggactcagcaccgccaccaaggacacctatg acgctcttcacatgcaggccctgccgcctcgg |
| hzCAR123-3 AA | 1154 | MALPVTALLLPLALLLHAARPQVQLVQSGAEVKKPGASVKVSCKASGYTFTSYWMNWVRQ APGQGLEWMGRIDPYDSETHYNQKFKDRVTMTVDKSTSTAYMELSSLRSEDTAVYYCARG NWDDYWGQGTTVTVSSGGGGSGGGGSGGGGSGGGGSDVVMTQSPAFLSVTPGEKVTITCR ASKSISKDLAWYQQKPDQAPKLLIYSGSTLQSGVPSRFSGSGSGTDFTFTISSLEAEDAA TYYCQQHNKYPYTFGGGTKVEIKTTTPAPRPPTPAPTIASQPLSLRPEACRPAAGGAVHT RGLDFACDIYIWAPLAGTCGVLLLSLVITLYCKRGRKKLLYIFKQPFMRPVQTTQEEDGC SCRFPEEEEGGCELRVKFSRSADAPAYKQGQNQLYNELNLGRREEYDVLDKRRGRDPEMG GKPRRKNPQEGLYNELQKDKMAEAYSEIGMKGERRRGKGHDGLYQGLSTATKDTYDALHM QALPPR |
| hzCAR123-3 scFv | 1155 | MALPVTALLLPLALLLHAARPQVQLVQSGAEVKKPGASVKVSCKASGYTFTSYWMNWVRQ APGQGLEWMGRIDPYDSETHYNQKFKDRVTMTVDKSTSTAYMELSSLRSEDTAVYYCARG NWDDYWGQGTTVTVSSGGGGSGGGGSGGGGSGGGGSDVVMTQSPAFLSVTPGEKVTITCR ASKSISKDLAWYQQKPDQAPKLLIYSGSTLQSGVPSRFSGSGSGTDFTFTISSLEAEDAA TYYCQQHNKYPYTFGGGTKVEIK |
| hzCAR123-3 VH | 1156 | QVQLVQSGAEVKKPGASVKVSCKASGYTFTSYWMNWVRQAPGQGLEWMGRIDPYDSETHYNQ KFKDRVTMTVDKSTSTAYMELSSLRSEDTAVYYCARGNWDDYWGQGTTVTVSS |
| hzCAR123-3 VL | 1157 | DVVMTQSPAFLSVTPGEKVTITCRASKSISKDLAWYQQKPDQAPKLLIYSGSTLQSGVPSRF SGSGSGTDFTFTISSLEAEDAATYYCQQHNKYPYTFGGGTKVEIK |
| hzCAR123-4 NT | 1158 | ATGGCCCTCCCTGTCACCGCCCTGCTGCTTCCGCTGGCTCTTCTGCTCCACGCCGCTCGGCC CCAAGTGCAGCTGGTCCAGTCGGGAGCCGAAGTCAAGAAGCCCGGCGCTAGCGTGAAAGTGT CCTGCAAAGCCTCCGGGTACACATTCACCTCCTACTGGATGAATTGGGTCAGACAGGCGCCC GGCCAGGGACTCGAGTGGATGGGAAGGATTGATCCTTACGACTCCGAAACCCATTACAACCA GAAGTTCAAGGACCGCGTGACCATGACTGTGGATAAGTCCACTTCCACCGCTTACATGGAGC TGTCCAGCCTGCGCTCCGAGGATACCGCAGTGTACTACTGCGCCCGGGGAAACTGGGACGAC TATTGGGGACAGGGAACTACCGTGACCGTGTCAAGCGGGGGTGGCGGTAGCGGAGGAGGGGG CTCCGGCGGCGGCGGCTCAGGGGGCGGAGGAAGCGACGTGTCATGACTCAGTCCCCGGACT CACTCGCGGTGTCGCTTGGAGAGAGCGACCATCAACTGTCGGGCCTCAAAGAGCATCAGC AAGGACCTGGCCTGGTACCAGCAGAAGCCGGGACAGCCGCCAAAGCTGCTGATCTACTCCGG GTCCACCTTGCAATCGGTGCCCTGACCGGTTCTCCGGTTCCGGGTCGGGTACCGACTTCA CGCTCACTATTTCGTCGCTGCAAGCCGAAGATGTGGCCGTGTACTATTGCCAACAGCACAAC AAGTACCCCTACACTTTTGGCGGAGGCACCAAGGTGGAAATCAAGACCACTACCCCAGCACC GAGGCCACCCACCCCGGCTCCTACCATCGCCTCCCAGCCTCTGTCCCTGCGTCCGGAggcat gtagacccgcagctggtggggccgtgcataccggggtcttgacttcgcctgcgatatctac atttgggcccctctggctggtacttgcggggtcctgctgctttcactcgtgatcactcttta ctgtaagcgcggtcggaagaagctgctgtacatcttttaagcaaccccttcatgaggcctgtgc agactactcaagaggaggacggctgttcatgccggttcccagaggaggaggaaggcggctgc gaactgcgcgtgaaattcagccgcagcgcagatgctccagcctacaagcaggggcagaacca gctctacaacgaactcaatcttggtcggagagaggagtacgacgtgctggacaagcggagag gacgggacccagaaatgggcgggaagccgcgcagaaagaatccccaagagggcctgtacaac |

TABLE 25-continued

Humanized CD123 CAR Constructs

| Name | SEQ ID | Sequence |
|---|---|---|
| | | gagctccaaaaggataagatggcagaagcctatagcgagattggtatgaaaggggaacgcag aagaggcaaaggccacgacggactgtaccagggactcagcaccgccaccaaggacacctatg acgctcttcacatgcaggccctgccgcctcgg |
| hzCAR123-4 AA | 1159 | MALPVTALLLPLALLLHAARPQVQLVQSGAEVKKPGASVKVSCKASGYTFTSYWMNWVRQ APGQGLEWMGRIDPYDSETHYNQKFKDRVTMTVDKSTSTAYMELSSLRSEDTAVYYCARG NWDDYWGQGTTVTVSSGGGGSGGGGSGGGGSGGGGSDVVMTQSPDSLAVSLGERATINCR ASKSISKDLAWYQQKPGQPPKLLIYSGSTLQSGVPDRFSGSGSGTDFTLTISSLQAEDVA VYYCQQHNKYPYTFGGGTKVEIKTTTPAPRPPTPAPTIASQPLSLRPEACRPAAGGAVHT RGLDFACDIYIWAPLAGTCGVLLLSLVITLYCKRGRKKLLYIFKQPFMRPVQTTQEEDGC SCRFPEEEEGGCELRVKFSRSADAPAYKQGQNQLYNELNLGRREEYDVLDKRRGRDPEMG GKPRRKNPQEGLYNELQKDKMAEAYSEIGMKGERRRGKGHDGLYQGLSTATKDTYDALHM QALPPR |
| hzCAR123-4 scFv | 1160 | MALPVTALLLPLALLLHAARPQVQLVQSGAEVKKPGASVKVSCKASGYTFTSYWMNWVRQ APGQGLEWMGRIDPYDSETHYNQKFKDRVTMTVDKSTSTAYMELSSLRSEDTAVYYCARG NWDDYWGQGTTVTVSSGGGGSGGGGSGGGGSGGGGSDVVMTQSPDSLAVSLGERATINCR ASKSISKDLAWYQQKPGQPPKLLIYSGSTLQSGVPDRFSGSGSGTDFTLTISSLQAEDVA VYYCQQHNKYPYTFGGGTKVEIK |
| hzCAR123-4 VH | 1161 | QVQLVQSGAEVKKPGASVKVSCKASGYTFTSYWMNWVRQAPGQGLEWMGRIDPYDSETHYNQ KFKDRVTMTVDKSTSTAYMELSSLRSEDTAVYYCARGNWDDYWGQGTTVTVSS |
| hzCAR123-4 VL | 1162 | DVVMTQSPDSLAVSLGERATINCRASKSISKDLAWYQQKPGQPPKLLIYSGSTLQSGVPDRF SGSGSGTDFTLTISSLQAEDVAVYYCQQHNKYPYTFGGGTKVEIK |
| hzCAR123-5 NT | 1163 | ATGGCCCTCCCTGTCACCGCCCTGCTGCTTCCGCTGGCTCTTCTGCTCCACGCCGCTCGGCC CGACGTGCAGCTCACCCAGTCGCCCTCATTTCTGTCGGCCTCAGTGGGAGACAGAGTGACCA TTACTTGTCGGGCCTCCAAGAGCATCTCCAAGGACCTGGCCTGGTATCAGCAGAAGCCAGGA AAGGCGCCTAAGTTGCTCATCTACTCGGGGTCGACCCTGCAATCTGGCGTGCCGTCCCGGTT CTCCGGTTCGGGAAGCGGTACCGAATTCACCCTTACTATCTCCTCCCTGCAACCGGAGGACT TCGCCACCTACTACTGCCAACAGCACAACAAGTACCCGTACACTTTCGGGGGTGGCACGAAG GTCGAAATCAAGGGGGGTGGCGGTAGCGGAGGAGGGGGCTCCGGCGGCGGCGGCTCAGGGGG CGGAGGAAGCCAAGTGCAGCTGGTCCAGTCGGGAGCCGAAGTCAAGAAGCCCGGCGCTAGCG TGAAAGTGTCCTGCAAAGCCTCCGGGTACACATTCACCTCCTACTGGATGAATTGGGTCAGA CAGGCGCCCGGCCAGGGACTCGAGTGGATGGGAAGGATTGATCCTTACGACTCCGAAACCCA TTACAACCAGAAGTTCAAGGACCGCGTGACCATGACTGTGGATAAGTCCACTTCCACCGCTT ACATGGAGCTGTCCAGCCTGCGCTCCGAGGATACCGCAGTGTACTACTGCGCCCGGGGAAAC TGGGACGACTATTGGGGACAGGGAACTACCGTGACCGTGTCAAGCACCACTACCCCAGCACC GAGGCCACCCACCCCGGCTCCTACCATCGCCTCCCAGCCTCTGTCCCTGCGTCCGGAggcat gtagacccgcagctggtggggccgtgcataccggggtcttgacttcgcctgcgatatctac atttgggcccctctggctggtacttgcggggtcctgctgctttcactcgtgatcactcttta ctgtaagcgcggtcggaagaagcttctgtacatctttaagcaaccttcatgaggcctgtgc agactactcaagaggaggacggctgttcatgccggttcccagaggaggaggaaggcggctgc gaactgcgcgtgaaattcagccgcagcgcagatgctccagcctacaagcaggggcagaacca gctctacaacgaactcaatcttggtcggagagaggagtacgacgtgctggacaagcggagag gacgggacccagaaatgggcgggaagccgcgcagaaagaatcccaagagggcctgtacaac gagctccaaaaggataagatggcagaagcctatagcgagattggtatgaaaggggaacgcag aagaggcaaaggccacgacggactgtaccagggactcagcaccgccaccaaggacacctatg acgctcttcacatgcaggccctgccgcctcgg |
| hzCAR123-5 AA | 1164 | MALPVTALLLPLALLLHAARPDVQLTQSPSFLSASVGDRVTITCRASKSISKDLAWYQQK PGKAPKLLIYSGSTLQSGVPSRFSGSGSGTEFTLTISSLQPEDFATYYCQQHNKYPYTFG GGTKVEIKGGGGSGGGGSGGGGSGGGGSQVQLVQSGAEVKKPGASVKVSCKASGYTFTSY WMNWVRQAPGQGLEWMGRIDPYDSETHYNQKFKDRVTMTVDKSTSTAYMELSSLRSEDTA VYYCARGNWDDYWGQGTTVTVSSTTTPAPRPPTPAPTIASQPLSLRPEACRPAAGGAVHT RGLDFACDIYIWAPLAGTCGVLLLSLVITLYCKRGRKKLLYIFKQPFMRPVQTTQEEDGC SCRFPEEEEGGCELRVKFSRSADAPAYKQGQNQLYNELNLGRREEYDVLDKRRGRDPEMG GKPRRKNPQEGLYNELQKDKMAEAYSEIGMKGERRRGKGHDGLYQGLSTATKDTYDALHM QALPPR |
| hzCAR123-5 scFv | 1165 | MALPVTALLLPLALLLHAARPDVQLTQSPSFLSASVGDRVTITCRASKSISKDLAWYQQK PGKAPKLLIYSGSTLQSGVPSRFSGSGSGTEFTLTISSLQPEDFATYYCQQHNKYPYTFG GGTKVEIKGGGGSGGGGSGGGGSGGGGSQVQLVQSGAEVKKPGASVKVSCKASGYTFTSY WMNWVRQAPGQGLEWMGRIDPYDSETHYNQKFKDRVTMTVDKSTSTAYMELSSLRSEDTA VYYCARGNWDDYWGQGTTVTVSS |
| hzCAR123-5 VH | 1166 | QVQLVQSGAEVKKPGASVKVSCKASGYTFTSYWMNWVRQAPGQGLEWMGRIDPYDSETHYNQ KFKDRVTMTVDKSTSTAYMELSSLRSEDTAVYYCARGNWDDYWGQGTTVTVSS |
| hzCAR123-5 VL | 1167 | DVQLTQSPSFLSASVGDRVTITCRASKSISKDLAWYQQKPGKAPKLLIYSGSTLQSGVPSRF SGSGSGTEFTLTISSLQPEDFATYYCQQHNKYPYTFGGGTKVEIK |
| hzCAR123-6 NT | 1168 | ATGGCCCTCCCTGTCACCGCCCTGCTGCTTCCGCTGGCTCTTCTGCTCCACGCCGCTCGGCC CGAAGTGGTGCTGACCCAGTCGCCCGCAACCCTCTCTCTGTCGCCGGGAGAACGCGCCACTC |

TABLE 25-continued

Humanized CD123 CAR Constructs

| Name | SEQ ID | Sequence |
|---|---|---|
| | | TTTCCTGTCGGGCGTCCAAGAGCATCTCAAAGGACCTCGCCTGGTACCAGCAGAAGCCTGGT
CAAGCCCCGCGGCTGCTGATCTACTCCGGCTCCACGCTGCAATCAGGAATCCCAGCCAGATT
TTCCGGTTCGGGGTCGGGGACTGACTTCACCTTGACCATTAGCTCGCTGGAACCTGAGGACT
TCGCCGTGTATTACTGCCAGCAGCACAACAAGTACCCGTACACCTTCGGAGGCGGTACTAAG
GTCGAGATCAAGGGGGGTGGCGGTAGCGGAGGAGGGGGCTCCGGCGGCGGCGGCTCAGGGGG
CGGAGGAAGCCAAGTGCAGCTGGTCCAGTCGGGAGCCGAAGTCAAGAAGCCCGGCGCTAGCG
TGAAAGTGTCCTGCAAAGCCTCCGGGTACACATTCACCTCCTACTGGATGAATTGGGTCAGA
CAGGCGCCCGGCCAGGGACTCGAGTGGATGGGAAGGATTGATCCTTACGACTCCGAAACCCA
TTACAACCAGAAGTTCAAGGACCGCGTGACCATGACTGTGGATAAGTCCACTTCCACCGCTT
ACATGGAGCTGTCCAGCCTGCGCTCCGAGGATACCGCAGTGTACTACTGCGCCCGGGGAAAC
TGGGACGACTATTGGGGACAGGGAACTACCGTGACCGTGTCAAGCACCACTACCCCAGCACC
GAGGCCACCCACCCCGGCTCCTACCATCGCCTCCCAGCCTCTGTCCCTGCGTCCGAAggcat
gtagacccgcagctggtggggccgtgcatacccggggtcttgacttcgcctgcgatatctac
atttgggcccctctggctggtacttgcggggtcctgctgctttcactcgtgatcactctttta
ctgtaagcgcggtcggaagaagctgctgtacatctttaagcaaccttcatgaggcctgtgc
agactactcaagaggaggacggctgttcatgccggttcccagaggaggaggaaggcggctgc
gaactgcgcgtgaaattcagccgcagcgcagatgctccagcctacaagcaggggcagaacca
gctctacaacgaactcaatcttggtcggagagaggagtacgacgtgctggacaagcggagag
gacgggacccagaaatgggcgggaagccgcgcagaaagaatcccccaagagggcctgtacaac
gagctccaaaaggataagatggcagaagcctatagcgagattggtatgaaaggggaacgcag
aagaggcaaaggccacgacggactgtaccagggactcagcaccgccaccaaggacacctatg
acgctcttcacatgcaggccctgccgcctcgg |
| hzCAR123-6 AA | 1169 | MALPVTALLLPLALLLHAARPEVVLTQSPATLSLSPGERATLSCRASKSISKDLAWYQQK
PGQAPRLLIYSGSTLQSGIPARFSGSGSGTDFTLTISSLEPEDFAVYYCQQHNKYPYTFG
GGTKVEIKGGGGSGGGGSGGGGSGGGGSQVQLVQSGAEVKKPGASVKVSCKASGYTFTSY
WMNWVRQAPGQGLEWMGRIDPYDSETHYNQKFKDRVTMTVDKSTSTAYMELSSLRSEDTA
VYYCARGNWDDYWGQGTTVTVSSTTTPAPRPPTPAPTIASQPLSLRPEACRPAAGGAVHT
RGLDFACDIYIWAPLAGTCGVLLLSLVITLYCKRGRKKLLYIFKQPFMRPVQTTQEEDGC
SCRFPEEEEGGCELRVKFSRSADAPAYKQGQNQLYNELNLGRREEYDVLDKRRGRDPEMG
GKPRRKNPQEGLYNELQKDKMAEAYSEIGMKGERRRGKGHDGLYQGLSTATKDTYDALHM
QALPPR |
| hzCAR123-6 scFv | 1170 | MALPVTALLLPLALLLHAARPEVVLTQSPATLSLSPGERATLSCRASKSISKDLAWYQQK
PGQAPRLLIYSGSTLQSGIPARFSGSGSGTDFTLTISSLEPEDFAVYYCQQHNKYPYTFG
GGTKVEIKGGGGSGGGGSGGGGSGGGGSQVQLVQSGAEVKKPGASVKVSCKASGYTFTSY
WMNWVRQAPGQGLEWMGRIDPYDSETHYNQKFKDRVTMTVDKSTSTAYMELSSLRSEDTA
VYYCARGNWDDYWGQGTTVTVSS |
| hzCAR123-6 VH | 1171 | QVQLVQSGAEVKKPGASVKVSCKASGYTFTSYWMNWVRQAPGQGLEWMGRIDPYDSETHYNQ
KFKDRVTMTVDKSTSTAYMELSSLRSEDTAVYYCARGNWDDYWGQGTTVTVSS |
| hzCAR123-6 VL | 1172 | EVVLTQSPATLSLSPGERATLSCRASKSISKDLAWYQQKPGQAPRLLIYSGSTLQSGIPARF
SGSGSGTDFTLTISSLEPEDFAVYYCQQHNKYPYTFGGGTKVEIK |
| hzCAR123-7 NT | 1173 | ATGGCCCTCCCTGTCACCGCCCTGCTGCTTCCGCTGGCTCTTCTGCTCCACGCCGCTCGGCC
CGACGTCGTGATGACCCAGTCACCGGCATTCCTGTCCGTGACTCCCGGAGAAAAGGTCACGA
TTACTTGCCGGGCGTCCAAGAGCATCTCCAAGGACCTCGCCTGGTACCAACAGAAGCCGGAC
CAGGCCCCTAAGCTGTTGATCTACTCGGGGTCCACCCTTCAATCGGGAGTGCCATCGCGGTT
TAGCGGTTCGGGTTCTGGGACCGACTTCACTTTCACCATCTCCTCACTGGAAGCCGAGGATG
CCGCCACTTACTACTGTCAGCAGCACAACAAGTATCCGTACACCTTCGGAGGCGGTACCAAA
GTGGAGATCAAGGGGGGTGGCGGTAGCGGAGGAGGGGGCTCCGGCGGCGGCGGCTCAGGGGG
CGGAGGAAGCCAAGTGCAGCTGGTCCAGTCGGGAGCCGAAGTCAAGAAGCCCGGCGCTAGCG
TGAAAGTGTCCTGCAAAGCCTCCGGGTACACATTCACCTCCTACTGGATGAATTGGGTCAGA
CAGGCGCCCGGCCAGGGACTCGAGTGGATGGGAAGGATTGATCCTTACGACTCCGAAACCCA
TTACAACCAGAAGTTCAAGGACCGCGTGACCATGACTGTGGATAAGTCCACTTCCACCGCTT
ACATGGAGCTGTCCAGCCTGCGCTCCGAGGATACCGCAGTGTACTACTGCGCCCGGGGAAAC
TGGGACGACTATTGGGGACAGGGAACTACCGTGACCGTGTCAAGCACCACTACCCCAGCACC
GAGGCCACCCACCCCGGCTCCTACCATCGCCTCCCAGCCTCTGTCCCTGCGTCCGAAggcat
gtagacccgcagctggtggggccgtgcatacccggggtcttgacttcgcctgcgatatctac
atttgggcccctctggctggtacttgcggggtcctgctgctttcactcgtgatcactctttta
ctgtaagcgcggtcggaagaagctgctgtacatctttaagcaaccttcatgaggcctgtgc
agactactcaagaggaggacggctgttcatgccggttcccagaggaggaggaaggcggctgc
gaactgcgcgtgaaattcagccgcagcgcagatgctccagcctacaagcaggggcagaacca
gctctacaacgaactcaatcttggtcggagagaggagtacgacgtgctggacaagcggagag
gacgggacccagaaatgggcgggaagccgcgcagaaagaatcccccaagagggcctgtacaac
gagctccaaaaggataagatggcagaagcctatagcgagattggtatgaaaggggaacgcag
aagaggcaaaggccacgacggactgtaccagggactcagcaccgccaccaaggacacctatg
acgctcttcacatgcaggccctgccgcctcgg |
| hzCAR123-7 AA | 1174 | MALPVTALLLPLALLLHAARPDVVMTQSPAFLSVTPGEKVTITCRASKSISKDLAWYQQK
PDQAPKLLIYSGSTLQSGVPSRFSGSGSGTDFTFTISSLEAEDAATYYCQQHNKYPYTFG
GGTKVEIKGGGGSGGGGSGGGGSGGGGSQVQLVQSGAEVKKPGASVKVSCKASGYTFTSY
WMNWVRQAPGQGLEWMGRIDPYDSETHYNQKFKDRVTMTVDKSTSTAYMELSSLRSEDTA
VYYCARGNWDDYWGQGTTVTVSSTTTPAPRPPTPAPTIASQPLSLRPEACRPAAGGAVHT |

TABLE 25-continued

Humanized CD123 CAR Constructs

| Name | SEQ ID | Sequence |
|---|---|---|
| | | RGLDFACDIYIWAPLAGTCGVLLLSLVITLYCKRGRKKLLYIFKQPFMRPVQTTQEEDGC<br>SCRFPEEEEGGCELRVKFSRSADAPAYKQGQNQLYNELNLGRREEYDVLDKRRGRDPEMG<br>GKPRRKNPQEGLYNELQKDKMAEAYSEIGMKGERRRGKGHDGLYQGLSTATKDTYDALHM<br>QALPPR |
| hzCAR123-7 scFv | 1175 | MALPVTALLLPLALLLHAARPDVVMTQSPAFLSVTPGEKVTITCRASKSISKDLAWYQQK<br>PDQAPKLLIYSGSTLQSGVPSRFSGSGSGTDFTFTISSLEAEDAATYYCQQHNKYPYTFG<br>GGTKVEIKGGGGSGGGGSGGGGSGGGGSQVQLVQSGAEVKKPGASVKVSCKASGYTFTSY<br>WMNWVRQAPGQGLEWMGRIDPYDSETHYNQKFKDRVTMTVDKSTSTAYMELSSLRSEDTA<br>VYYCARGNWDDYWGQGTTVTVSS |
| hzCAR123-7 VH | 1176 | QVQLVQSGAEVKKPGASVKVSCKASGYTFTSYWMNWVRQAPGQGLEWMGRIDPYDSETHYNQ<br>KFKDRVTMTVDKSTSTAYMELSSLRSEDTAVYYCARGNWDDYWGQGTTVTVSS |
| hzCAR123-7 VL | 1177 | DVVMTQSPAFLSVTPGEKVTITCRASKSISKDLAWYQQKPDQAPKLLIYSGSTLQSGVPSRF<br>SGSGSGTDFTFTISSLEAEDAATYYCQQHNKYPYTFGGGTKVEIK |
| hzCAR123-8 NT | 1178 | ATGGCCCTCCCTGTCACCGCCCTGCTGCTTCCGCTGGCTCTTCTGCTCCACGCCGCTCGGCC<br>CGACGTGGTCATGACTCAGTCCCCGGACTCACTCGCGGTGTCGCTTGGAGAGAGAGCGACCA<br>TCAACTGTCGGGCCTCAAAGAGCATCAGCAAGGACCTGGCTACCAGCAGAAGCCGGGA<br>CAGCCGCCAAAGCTGCTGATCTACTCCGGGTCCACCTTGCAATCTGGTGTCCCTGACCGGTT<br>CTCCGGTTCCGGGTCGGGTACCGACTTCACGCTCACTATTTCGTCGCTGCAAGCCGAAGATG<br>TGGCCGTGTACTATTGCCAACAGCACAACAAGTACCCCTACACTTTTGGCGGAGGCACCAAG<br>GTGGAAATCAAGGGGGGTGGCGGTAGCGGAGGAGGGGGCTCCGGCGGCGGCGGCTCAGGGGG<br>CGGAGGAAGCCAAGTGCAGCTGGTCCAGTCGGGAGCCGAAGTCAAGAAGCCCGGCGCTAGCG<br>TGAAAGTGTCCTGCAAAGCCTCCGGGTACACATTCACCTCCTACTGGATGAATTGGGTCAGA<br>CAGGCGCCCGGCCAGGGACTCGAGTGGATGGGAAGGATTGATCCTTACGACTCCGAAACCCA<br>TTACAACCAGAAGTTCAAGGACCGCGTGACCATGACTGTGGATAAGTCCACTTCCACCGCTT<br>ACATGGAGCTGTCCAGCCTGCGCTCCGAGGATACCGCAGTGTACTACTGCGCCGGGGAAAC<br>TGGGACGACTATTGGGGACAGGGAACTACCGTGACCGTGTCAAGCACCACTACCCCAGCACC<br>GAGGCCACCCACCCCGGCTCCTACCATCGCCTCCCAGCCTCTGTCCCTGCGTCCGGAggcat<br>gtagacccgcagctggtggggccgtgcatacccgggggtcttgacttcgcctgcgatatctac<br>atttgggcccctctggctggtacttgcggggtcctgctgcttcactcgtgatcactcttta<br>ctgtaagcgcggtcggaagaagctgctgtacatcttttaagcaaccttcatgaggcctgtgc<br>agactactaagaggaggacggctgttcatgccggttcccagaggaggaggaaggcggctgc<br>gaactgcgcgtgaaattcagccgcagcgcagatgctccagcctacaagcaggggcagaacca<br>gctctacaacgaactcaatcttggtcggagagaggagtacgacgtgctggacaagcggagag<br>gacgggacccagaaatgggcgggaagccgcgcagaaagaatcccaagagggcctgtacaac<br>gagctccaaaaggataagatggcagaagcctatagcgagattggtatgaaaggggaacgcag<br>aagaggcaaaggccacgacggactgtaccagggactcagcaccgccaccaaggacacctatg<br>acgctcttcacatgcaggccctgccgcctcgg |
| hzCAR123-8 AA | 1179 | MALPVTALLLPLALLLHAARPDVVMTQSPDSLAVSLGERATINCRASKSISKDLAWYQQK<br>PGQPPKLLIYSGSTLQSGVPDRFSGSGSGTDFTLTISSLQAEDVAVYYCQQHNKYPYTFG<br>GGTKVEIKGGGGSGGGGSGGGGSGGGGSQVQLVQSGAEVKKPGASVKVSCKASGYTFTSY<br>WMNWVRQAPGQGLEWMGRIDPYDSETHYNQKFKDRVTMTVDKSTSTAYMELSSLRSEDTA<br>VYYCARGNWDDYWGQGTTVTVSSTTTPAPRPPTPAPTIASQPLSLRPEACRPAAGGAVHT<br>RGLDFACDIYIWAPLAGTCGVLLLSLVITLYCKRGRKKLLYIFKQPFMRPVQTTQEEDGC<br>SCRFPEEEEGGCELRVKFSRSADAPAYKQGQNQLYNELNLGRREEYDVLDKRRGRDPEMG<br>GKPRRKNPQEGLYNELQKDKMAEAYSEIGMKGERRRGKGHDGLYQGLSTATKDTYDALHM<br>QALPPR |
| hzCAR123-8 scFv | 1180 | MALPVTALLLPLALLLHAARPDVVMTQSPDSLAVSLGERATINCRASKSISKDLAWYQQK<br>PGQPPKLLIYSGSTLQSGVPDRFSGSGSGTDFTLTISSLQAEDVAVYYCQQHNKYPYTFG<br>GGTKVEIKGGGGSGGGGSGGGGSGGGGSQVQLVQSGAEVKKPGASVKVSCKASGYTFTSY<br>WMNWVRQAPGQGLEWMGRIDPYDSETHYNQKFKDRVTMTVDKSTSTAYMELSSLRSEDTA<br>VYYCARGNWDDYWGQGTTVTVSS |
| hzCAR123-8 VH | 1181 | QVQLVQSGAEVKKPGASVKVSCKASGYTFTSYWMNWVRQAPGQGLEWMGRIDPYDSETHYNQ<br>KFKDRVTMTVDKSTSTAYMELSSLRSEDTAVYYCARGNWDDYWGQGTTVTVSS |
| hzCAR123-8 VL | 1182 | DVVMTQSPDSLAVSLGERATINCRASKSISKDLAWYQQKPGQPPKLLIYSGSTLQSGVPDRF<br>SGSGSGTDFTLTISSLQAEDVAVYYCQQHNKYPYTFGGGTKVEIK |
| hzCAR123-9 NT | 1183 | ATGGCCCTCCCTGTCACCGCCCTGCTGCTTCCGCTGGCTCTTCTGCTCCACGCCGCTCGGCC<br>CCAAGTGCAGCTGGTGCAGTCAGGCAGCGAACTGAAGAAGCCCGGAGCCTCCGTCAAAGTGT<br>CCTGCAAAGCCTCGGGATACACCTTCACCTCCTACTGGATGAACTGGGTCCGCCAGGCACCT<br>GGACAGGGGCTGGAGTGGATGGGAAGGATCGATCCCTACGATTCCGAAACCCATTACAATCA<br>GAAGTTCAAGGACCGGTTTGTGTTCTCCGTGGACAAGTCCGTGTCCACCGCCTACCTCCAAA<br>TTAGCAGCCTGAAGGCGGAGGATACAGCTGTCTACTACTGCGCTCGCGGAAACTGGATGAC<br>TATTGGGGCCAGGGAACTACCGTGACTGTGTCCTCCGGGGGTGGCGGTAGCGGAGGAGGGGG<br>CTCCGGCGGCGGCGGCTCAGGGGGCGGAGGAAGCGACGTGCAGCTCACCCAGTCGCCCTCAT<br>TTCTGTCGGCCTCAGTGGAGACAGAGTGACCATTACTTGTCGGGCCTCCAAGAGCATCTCC<br>AAGGACCTGGCCTGGTATCAGCAGAAGCCAGGAAAGGCGCCTAAGTTGCTCATCTACTCGGG<br>GTCGACCCTGCAATCGGCGTGCCGTCCCGGTTCTCCGGTTCGGGAAGCGGTACCGAATTCA |

TABLE 25-continued

Humanized CD123 CAR Constructs

| Name | SEQ ID | Sequence |
|---|---|---|
| | | CCCTTACTATCTCCTCCCTGCAACCGGAGGACTTCGCCACCTACTACTGCCAACAGCACAAC
AAGTACCCGTACACTTTCGGGGGTGGCACGAAGGTCGAAATCAAGACCACTACCCCAGCACC
GAGGCCACCCACCCCGGCTCCTACCATCGCCTCCCAGCCTCTGTCCCTGCGTCCGGAggcat
gtagacccgcagctggtggggccgtgcataccggggtcttgacttcgcctgcgatatctac
atttgggcccctctggctggtacttgcggggtcctgctgctttcactcgtgatcactcttta
ctgtaagcgcggtcggaagaagctgctgtacatctttaagcaaccttcatgaggcctgtgc
agactactcaagaggaggacggctgttcatgccggttcccagaggaggaggaaggcggctgc
gaactgcgcgtgaaattcagccgcagcgcagatgctccagcctacaagcaggggcagaacca
gctctacaacgaactcaatcttggtcggagagaggagtacgacgtgctggacaagcggagag
gacgggacccagaaatgggcggaagccgcgcagaaagaatcccaagagggcctgtacaac
gagctccaaaaggataagatggcagaagcctatagcgagattggtatgaaaggggaacgcag
aagaggcaaaggccacgacggactgtaccagggactcagcaccgccaccaaggacacctatg
acgctcttcacatgcaggccctgccgcctcgg |
| hzCAR123-9 AA | 1184 | MALPVTALLLPLALLLHAARPQVQLVQSGSELKKPGASVKVSCKASGYTFTSYWMNWVRQ
APGQGLEWMGRIDPYDSETHYNQKFKDRFVFSVDKSVSTAYLQISSLKAEDTAVYYCARG
NWDDYWGQGTTVTVSSGGGGSGGGGSGGGGSGGGGSDVQLTQSPSFLSASVGDRVTITCR
ASKSISKDLAWYQQKPGKAPKLLIYSGSTLQSGVPSRFSGSGSGTEFTLTISSLQPEDFA
TYYCQQHNKYPYTFGGGTKVEIKTTTPAPRPPTPAPTIASQPLSLRPEACRPAAGGAVHT
RGLDFACDIYIWAPLAGTCGVLLLSLVITLYCKRGRKKLLYIFKQPFMRPVQTTQEEDGC
SCRFPEEEEGGCELRVKFSRSADAPAYKQGQNQLYNELNLGRREEYDVLDKRRGRDPEMG
GKPRRKNPQEGLYNELQKDKMAEAYSEIGMKGERRRGKGHDGLYQGLSTATKDTYDALHM
QALPPR |
| hzCAR123-9 scFv | 1185 | MALPVTALLLPLALLLHAARPQVQLVQSGSELKKPGASVKVSCKASGYTFTSYWMNWVRQ
APGQGLEWMGRIDPYDSETHYNQKFKDRFVFSVDKSVSTAYLQISSLKAEDTAVYYCARG
NWDDYWGQGTTVTVSSGGGGSGGGGSGGGGSGGGGSDVQLTQSPSFLSASVGDRVTITCR
ASKSISKDLAWYQQKPGKAPKLLIYSGSTLQSGVPSRFSGSGSGTEFTLTISSLQPEDFA
TYYCQQHNKYPYTFGGGTKVEIK |
| hzCAR123-9 VH | 1186 | QVQLVQSGSELKKPGASVKVSCKASGYTFTSYWMNWVRQAPGQGLEWMGRIDPYDSETHYNQ
KFKDRFVFSVDKSVSTAYLQISSLKAEDTAVYYCARGNWDDYWGQGTTVTVSS |
| hzCAR123-10 VL | 1187 | DVQLTQSPSFLSASVGDRVTITCRASKSISKDLAWYQQKPGKAPKLLIYSGSTLQSGVPSRF
SGSGSGTEFTLTISSLQPEDFATYYCQQHNKYPYTFGGGTKVEIK |
| hzCAR123-10 NT | 1188 | ATGGCCCTCCCTGTCACCGCCCTGCTGCTTCCGCTGGCTCTTCTGCTCCACGCCGCTCGGCC
CCAAGTGCAGCTGGTGCAGTCAGGCAGCGAACTGAAGAAGCCCGGAGCCTCCGTCAAAGTGT
CCTGCAAAGCCTCGGGATACACCTTCACCTCCTACTGGATGAACTGGGTCCGCCAGGCACCT
GGACAGGGCTGGAGTGGATGGGAAGGATCGATCCCTACGATTCCGAAACCCATTACAATCA
GAAGTTCAAGGACCGGTTTGTGTTCTCCGTGGACAAGTCCGTGTCCACCGCCTACCTCCAA
TTAGCAGCCTGAAGGCGGAGGATACAGCTGTCTACTACTGCGCTCGCGGAAACTGGGATGAC
TATTGGGGCCAGGGAACTACCGTGACTGTGTCCTCCGGGGGTGGCGGTAGCGGAGGAGGGG
CTCCGGCGGCGGCGGCTCAGGGGGCGGAGGAAGCGAAGTGGTGCTGACCCAGTCGCCCGCAA
CCCTCTCTCTGTCGCCGGGAGAACGCGCCACTCTTTCCTGTCGGGCGTCCAAGAGCATCTCA
AAGGACCTCGCCTGGTACCAGCAGAAGCCTGGTCAAGCCCCGGGCTGCTGATCTACTCCGG
CTCCACGCTGCAATCAGGAATCCCAGCCAGATTTTCCGGTTCGGGGTCGGGGACTGACTTCA
CCTTGACCATTAGCTCGCTGGAACCTGAGGACTTCGCCGTGTATTACTGCCAGCAGCACAAC
AAGTACCCGTACACCTTCGGAGGCGGTACTAAGGTCGAGATCAAGACCACTACCCCAGCACC
GAGGCCACCCACCCCGGCTCCTACCATCGCCTCCCAGCCTCTGTCCCTGCGTCCGGAggcat
gtagacccgcagctggtggggccgtgcataccggggtcttgacttcgcctgcgatatctac
atttgggcccctctggctggtacttgcggggtcctgctgctttcactcgtgatcactcttta
ctgtaagcgcggtcggaagaagctgctgtacatctttaagcaaccttcatgaggcctgtgc
agactactcaagaggaggacggctgttcatgccggttcccagaggaggaggaaggcggctgc
gaactgcgcgtgaaattcagccgcagcgcagatgctccagcctacaagcaggggcagaacca
gctctacaacgaactcaatcttggtcggagagaggagtacgacgtgctggacaagcggagag
gacgggacccagaaatgggcggaagccgcgcagaaagaatcccaagagggcctgtacaac
gagctccaaaaggataagatggcagaagcctatagcgagattggtatgaaaggggaacgcag
aagaggcaaaggccacgacggactgtaccagggactcagcaccgccaccaaggacacctatg
acgctcttcacatgcaggccctgccgcctcgg |
| hzCAR123-10 AA | 1189 | MALPVTALLLPLALLLHAARPQVQLVQSGSELKKPGASVKVSCKASGYTFTSYWMNWVRQ
APGQGLEWMGRIDPYDSETHYNQKFKDRFVFSVDKSVSTAYLQISSLKAEDTAVYYCARG
NWDDYWGQGTTVTVSSGGGGSGGGGSGGGGSGGGGSEVVLTQSPATLSLSPGERATLSCR
ASKSISKDLAWYQQKPGQAPRLLIYSGSTLQSGIPARFSGSGSGTDFTLTISSLEPEDFA
VYYCQQHNKYPYTFGGGTKVEIKTTTPAPRPPTPAPTIASQPLSLRPEACRPAAGGAVHT
RGLDFACDIYIWAPLAGTCGVLLLSLVITLYCKRGRKKLLYIFKQPFMRPVQTTQEEDGC
SCRFPEEEEGGCELRVKFSRSADAPAYKQGQNQLYNELNLGRREEYDVLDKRRGRDPEMG
GKPRRKNPQEGLYNELQKDKMAEAYSEIGMKGERRRGKGHDGLYQGLSTATKDTYDALHM
QALPPR |
| hzCAR123-10 scFv | 1190 | MALPVTALLLPLALLLHAARPQVQLVQSGSELKKPGASVKVSCKASGYTFTSYWMNWVRQ
APGQGLEWMGRIDPYDSETHYNQKFKDRFVFSVDKSVSTAYLQISSLKAEDTAVYYCARG
NWDDYWGQGTTVTVSSGGGGSGGGGSGGGGSGGGGSEVVLTQSPATLSLSPGERATLSCR |

TABLE 25-continued

Humanized CD123 CAR Constructs

| Name | SEQ ID | Sequence |
| --- | --- | --- |
| | | ASKSISKDLAWYQQKPGQAPRLLIYSGSTLQSGIPARFSGSGSGTDFTLTISSLEPEDFA<br>VYYCQQHNKYPYTFGGGTKVEIK |
| hzCAR123-10<br>VH | 1191 | QVQLVQSGSELKKPGASVKVSCKASGYTFTSYWMNWVRQAPGQGLEWMGRIDPYDSETHYNQ<br>KFKDRFVFSVDKSVSTAYLQISSLKAEDTAVYYCARGNWDDYWGQGTTVTVSS |
| hzCAR123-10<br>VL | 1192 | EVVLTQSPATLSLSPGERATLSCRASKSISKDLAWYQQKPGQAPRLLIYSGSTLQSGIPARF<br>SGSGSGTDFTLTISSLEPEDFAVYYCQQHNKYPYTFGGGTKVEIK |
| hzCAR123-11<br>NT | 1193 | ATGGCCCTCCCTGTCACCGCCCTGCTGCTTCCGCTGGCTCTTCTGCTCCACGCCGCTCGGCC<br>CCAAGTGCAGCTGGTGCAGTCAGGCAGCGAACTGAAGAAGCCCGGAGCCTCCGTCAAAGTGT<br>CCTGCAAAGCCTCGGGATACACCTTCACCTCCTACTGGATGAACTGGGTCCGCCAGGCACCT<br>GGACAGGGGCTGGAGTGGATGGGAAGGATCGATCCCTACGATTCCGAAACCCATTACAATCA<br>GAAGTTCAAGGACCGGTTTGTGTTCTCCGTGGACAAGTCCGTGTCCACCGCCTACCTCCAAA<br>TTAGCAGCCTGAAGGCGGAGGATACAGCTGTCTACTACTGCGCTCGCGGAAACTGGGATGAC<br>TATTGGGGCCAGGGAACTACCGTGACTGTGTCCTCCGGGGGTGGCGGTAGCGGAGGAGGGGG<br>CTCCGGCGGCGGCGGCTCAGGGGGCGGAGGAAGCGACGTCGTGATGACCCAGTCACCGGCAT<br>TCCTGTCCGTGACTCCCGGAGAAAAGGTCACGATTACTTGCCGGGCGTCCAAGAGCATCTCC<br>AAGGACCTCGCCTGGTACCAACAGAAGCCGGACCAGGCCCCTAAGCTGTTGATCTACTCGGG<br>GTCCACCCTTCAATCGGGAGTGCCATCGCGGTTTAGCGGTTCGGGTTCTGGGACCGACTTCA<br>CTTTCACCATCTCCTCACTGGAAGCCGAGGATGCCGCCACTTACTACTGTCAGCAGCACAAC<br>AAGTATCCGTACACCTTCGGAGGCGGTACCAAAGTGGAGATCAAGACCACTACCCCAGCACC<br>GAGGCCACCCACCCCGGCTCCTACCATCGCCTCCCAGCCTCTGTCCCTGCGTCCGGAggcat<br>gtagaccgcagctggtggggccgtgcatacccggggtcttgacttcgcctgcgatatctac<br>atttgggcccctctggctggtacttgcggggtcctgctgctttcactcgtgatcactctta<br>ctgtaagcgcggtcggaagaagctgctgtacatctttaagcaaccttcatgaggcctgtgc<br>agactactcaagaggaggacggctgttcatgccggttcccagaggaggaggaaggcggctgc<br>gaactgcgcgtgaaattcagccgcagcgcagatgctccagcctacaagcaggggcagaacca<br>gctctacaacgaactcaatcttggtcggagagaggagtacgacgtgctggacaagcggagag<br>gacgggacccagaaatgggcgggaagccgcgcagaaagaatccccaagagggcctgtacaac<br>gagctccaaaggataagatggcagaagcctatagcgagattggtatgaaaggggaacgcag<br>aagaggcaaaggccacgacggactgtaccagggactcagcaccgccaccaaggacacctatg<br>acgctcttcacatgcaggccctgccgcctcgg |
| hzCAR123-11<br>AA | 1194 | MALPVTALLLPLALLLHAARPQVQLVQSGSELKKPGASVKVSCKASGYTFTSYWMNWVRQ<br>APGQGLEWMGRIDPYDSETHYNQKFKDRFVFSVDKSVSTAYLQISSLKAEDTAVYYCARG<br>NWDDYWGQGTTVTVSSGGGGSGGGGSGGGGSGGGGSDVVMTQSPAFLSVTPGEKVTITCR<br>ASKSISKDLAWYQQKPDQAPKLLIYSGSTLQSGVPSRFSGSGSGTDFTFTISSLEAEDAA<br>TYYCQQHNKYPYTFGGGTKVEIKTTTPAPRPPTPAPTIASQPLSLRPEACRPAAGGAVHT<br>RGLDFACDIYIWAPLAGTCGVLLLSLVITLYCKRGRKKLLYIFKQPFMRPVQTTQEEDGC<br>SCRFPEEEEGGCELRVKFSRSADAPAYKQGQNQLYNELNLGRREEYDVLDKRRGRDPEMG<br>GKPRRKNPQEGLYNELQKDKMAEAYSEIGMKGERRRGKGHDGLYQGLSTATKDTYDALHM<br>QALPPR |
| hzCAR123-11<br>scFv | 1195 | MALPVTALLLPLALLLHAARPQVQLVQSGSELKKPGASVKVSCKASGYTFTSYWMNWVRQ<br>APGQGLEWMGRIDPYDSETHYNQKFKDRFVFSVDKSVSTAYLQISSLKAEDTAVYYCARG<br>NWDDYWGQGTTVTVSSGGGGSGGGGSGGGGSGGGGSDVVMTQSPAFLSVTPGEKVTITCR<br>ASKSISKDLAWYQQKPDQAPKLLIYSGSTLQSGVPSRFSGSGSGTDFTFTISSLEAEDAA<br>TYYCQQHNKYPYTFGGGTKVEIK |
| hzCAR123-11<br>VH | 1196 | QVQLVQSGSELKKPGASVKVSCKASGYTFTSYWMNWVRQAPGQGLEWMGRIDPYDSETHYNQ<br>KFKDRFVFSVDKSVSTAYLQISSLKAEDTAVYYCARGNWDDYWGQGTTVTVSS |
| hzCAR123-11<br>VL | 1197 | DVVMTQSPAFLSVTPGEKVTITCRASKSISKDLAWYQQKPDQAPKLLIYSGSTLQSGVPSRF<br>SGSGSGTDFTFTISSLEAEDAATYYCQQHNKYPYTFGGGTKVEIK |
| hzCAR123-12<br>NT | 1198 | ATGGCCCTCCCTGTCACCGCCCTGCTGCTTCCGCTGGCTCTTCTGCTCCACGCCGCTCGGCC<br>CCAAGTGCAGCTGGTGCAGTCAGGCAGCGAACTGAAGAAGCCCGGAGCCTCCGTCAAAGTGT<br>CCTGCAAAGCCTCGGGATACACCTTCACCTCCTACTGGATGAACTGGGTCCGCCAGGCACCT<br>GGACAGGGGCTGGAGTGGATGGGAAGGATCGATCCCTACGATTCCGAAACCCATTACAATCA<br>GAAGTTCAAGGACCGGTTTGTGTTCTCCGTGGACAAGTCCGTGTCCACCGCCTACCTCCAAA<br>TTAGCAGCCTGAAGGCGGAGGATACAGCTGTCTACTACTGCGCTCGCGGAAACTGGGATGAC<br>TATTGGGGCCAGGGAACTACCGTGACTGTGTCCTCCGGGGGTGGCGGTAGCGGAGGAGGGGG<br>CTCCGGCGGCGGCGGCTCAGGGGGCGGAGGAAGCGACGTGGTCATGACTCAGTCCCCGGACT<br>CACTCGCGGTGTCGCTTGGAGAGAGAGCGACCATCAACTGTCGGGCCTCAAAGAGCATCAGC<br>AAGGACCTGGCCTGGTACCAGCAGAAGCCGGGACAGCCGCCAAAGCTGCTGATCTACTCCGG<br>GTCCACCTTGCAATCTGGTGTCCCTGACCGGTTCTCCGGTTCCGGTCGGGTACCGACTTCA<br>CGCTCACTATTTCGTCGCTGCAAGCCGAAGATGTGGCCGTGTACTATTGCCAACAGCACAAC<br>AAGTACCCTACACTTTTGGCGGAGGCACCAAGGTGGAAATCAAGACCACTACCCCAGCACC<br>GAGGCCACCCACCCCGGCTCCTACCATCGCCTCCCAGCCTCTGTCCCTGCGTCCGGAggcat<br>gtagaccgcagctggtggggccgtgcatacccggggtcttgacttcgcctgcgatatctac<br>atttgggcccctctggctggtacttgcggggtcctgctgctttcactcgtgatcactctttta<br>ctgtaagcgcggtcggaagaagctgctgtacatctttaagcaaccttcatgaggcctgtgc<br>agactactcaagaggaggacggctgttcatgccggttcccagaggaggaggaaggcggctgc<br>gaactgcgcgtgaaattcagccgcagcgcagatgctccagcctacaagcaggggcagaacca |

TABLE 25-continued

Humanized CD123 CAR Constructs

| Name | SEQ ID | Sequence |
|---|---|---|
| | | gctctacaacgaactcaatcttggtcggagagaggagtacgacgtgctggacaagcggagag gacgggacccagaaatgggcgggaagccgcgcagaaagaatcccaagagggcctgtacaac gagctccaaaaggataagatggcagaagcctatagcgagattggtatgaaggggaacgcag aagaggcaaaggccacgacggactgtaccagggactcagcaccgccaccaaggacacctatg acgctcttcacatgcaggccctgccgcctcgg |
| hzCAR123-12 AA | 1199 | MALPVTALLLPLALLLHAARPQVQLVQSGSELKKPGASVKVSCKASGYTFTSYWMNWVRQ APGQGLEWMGRIDPYDSETHYNQKFKDRFVFSVDKSVSTAYLQISSLKAEDTAVYYCARG NWDDYWGQGTTVTVSSGGGGSGGGGSGGGGSGGGGSDVVMTQSPDSLAVSLGERATINCR ASKSISKDLAWYQQKPGQPPKLLIYSGSTLQSGVPDRFSGSGSGTDFTLTISSLQAEDVA VYYCQQHNKYPYTFGGGTKVEIKTTTPAPRPPTPAPTIASQPLSLRPEACRPAAGGAVHT RGLDFACDIYIWAPLAGTCGVLLLSLVITLYCKRGRKKLLYIFKQPFMRPVQTTQEEDGC SCRFPEEEEGGCELRVKFSRSADAPAYKQGQNQLYNELNLGRREEYDVLDKRRGRDPEMG GKPRRKNPQEGLYNELQKDKMAEAYSEIGMKGERRRGKGHDGLYQGLSTATKDTYDALHM QALPPR |
| hzCAR123-12 scFv | 1200 | MALPVTALLLPLALLLHAARPQVQLVQSGSELKKPGASVKVSCKASGYTFTSYWMNWVRQ APGQGLEWMGRIDPYDSETHYNQKFKDRFVFSVDKSVSTAYLQISSLKAEDTAVYYCARG NWDDYWGQGTTVTVSSGGGGSGGGGSGGGGSGGGGSDVVMTQSPDSLAVSLGERATINCR ASKSISKDLAWYQQKPGQPPKLLIYSGSTLQSGVPDRFSGSGSGTDFTLTISSLQAEDVA VYYCQQHNKYPYTFGGGTKVEIK |
| hzCAR123-12 VH | 1201 | QVQLVQSGSELKKPGASVKVSCKASGYTFTSYWMNWVRQAPGQGLEWMGRIDPYDSETHYNQ KFKDRFVFSVDKSVSTAYLQISSLKAEDTAVYYCARGNWDDYWGQGTTVTVSS |
| hzCAR123-12 VL | 1202 | DVVMTQSPDSLAVSLGERATINCRASKSISKDLAWYQQKPGQPPKLLIYSGSTLQSGVPDRF SGSGSGTDFTLTISSLQAEDVAVYYCQQHNKYPYTFGGGTKVEIK |
| hzCAR123-13 NT | 1203 | ATGGCCCTCCCTGTCACCGCCCTGCTGCTTCCGCTGGCTCTTCTGCTCCACGCCGCTCGGCC CGACGTGCAGCTCACCCAGTCGCCCTCATTTCTGTCGGCCTCAGTGGGAGACAGAGTGACCA TTACTTGTCGGGCCTCCAAGAGCATCTCCAAGGACCTGGCCTGGTATCAGCAGAAGCCAGGA AAGGCGCCTAAGTTGCTCATCTACTCGGGGTCGACCCTGCAATCTGGCGTGCCGTCCCGGTT CTCCGGTTCGGGAAGCGGTACCGAATTCACCCTTACTATCTCCTCCCTGCAACCGGAGGACT TCGCCACCTACTACTGCCAACAGCACAACAAGTACCCGTACACTTTCGGGGGTGGCACGAAG GTCGAAATCAAGGGGGGTGGCGGTAGCGGAGGAGGGGGCTCCGGCGGCGGCGGCTCAGGGGG CGGAGGAAGCCAAGTGCAGCTGGTGCAGTCAGGCAGCGAACTGAAGAAGCCCGGAGCCTCCG TCAAAGTGTCCTGCAAAGCCTCGGGATACACCTTCACCTCCTACTGGATGAACTGGGTCCGC CAGGCACCTGGACAGGGGCTGGAGTGGATGGGAAGGATCGATCCCTACGATTCCGAAACCCA TTACAATCAGAAGTTCAAGGACCGGTTTGTGTTCTCCGTGGACAAGTCCGTGTCCACCGCCT ACCTCCAAATTAGCAGCCTGAAGGCGGAGGATACAGCTGTCTACTACTGCGCTCGCGGAAAC TGGGATGACTATTGGGGCCAGGGAACTACCGTGACTGTCTCCACCACTACCCCAGCACC GAGGCCACCCACCCCGGCTCCTACCATCGCCTCCCAGCCTCTGTCCCTGCGTCCGGAggcat gtagacccgcagctggtggggccgtgcatacccggggtcttgacttcgcctgcgatatctac atttgggcccctctggctggtacttgcggggtcctgctgctttcactcgtgatcactctta ctgtaagcgcggtcggaagaagctgctgtacatcttaagcaaccttcatgaggcctgtgc agactactcaagaggaggacggctgttcatgccggttcccagaggaggaggaaggcggctgg gaactgcgcgtgaaattcagccgcagcgcagatgctccagcctacaagcaggggcagaacca gctctacaacgaactcaatcttggtcggagagaggagtacgacgtgctggacaagcggagag gacgggacccagaaatgggcgggaagccgcgcagaaagaatcccaagagggcctgtacaac gagctccaaaaggataagatggcagaagcctatagcgagattggtatgaaggggaacgcag aagaggcaaaggccacgacggactgtaccagggactcagcaccgccaccaaggacacctatg acgctcttcacatgcaggccctgccgcctcgg |
| hzCAR123-13 AA | 1204 | MALPVTALLLPLALLLHAARPDVQLTQSPSFLSASVGDRVTITCRASKSISKDLAWYQQK PGKAPKLLIYSGSTLQSGVPSRFSGSGSGTEFTLTISSLQPEDFATYYCQQHNKYPYTFG GGTKVEIKGGGGSGGGGSGGGGSGGGGSQVQLVQSGSELKKPGASVKVSCKASGYTFTSY WMNWVRQAPGQGLEWMGRIDPYDSETHYNQKFKDRFVFSVDKSVSTAYLQISSLKAEDTA VYYCARGNWDDYWGQGTTVTVSSTTTPAPRPPTPAPTIASQPLSLRPEACRPAAGGAVHT RGLDFACDIYIWAPLAGTCGVLLLSLVITLYCKRGRKKLLYIFKQPFMRPVQTTQEEDGC SCRFPEEEEGGCELRVKFSRSADAPAYKQGQNQLYNELNLGRREEYDVLDKRRGRDPEMG GKPRRKNPQEGLYNELQKDKMAEAYSEIGMKGERRRGKGHDGLYQGLSTATKDTYDALHM QALPPR |
| hzCAR123-13 scFv | 1205 | MALPVTALLLPLALLLHAARPDVQLTQSPSFLSASVGDRVTITCRASKSISKDLAWYQQK PGKAPKLLIYSGSTLQSGVPSRFSGSGSGTEFTLTISSLQPEDFATYYCQQHNKYPYTFG GGTKVEIKGGGGSGGGGSGGGGSGGGGSQVQLVQSGSELKKPGASVKVSCKASGYTFTSY WMNWVRQAPGQGLEWMGRIDPYDSETHYNQKFKDRFVFSVDKSVSTAYLQISSLKAEDTA VYYCARGNWDDYWGQGTTVTVSS |
| hzCAR123-13 VH | 1206 | QVQLVQSGSELKKPGASVKVSCKASGYTFTSYWMNWVRQAPGQGLEWMGRIDPYDSETHYNQ KFKDRFVFSVDKSVSTAYLQISSLKAEDTAVYYCARGNWDDYWGQGTTVTVSS |
| hzCAR123-13 VL | 1207 | DVQLTQSPSFLSASVGDRVTITCRASKSISKDLAWYQQKPGKAPKLLIYSGSTLQSGVPSRF SGSGSGTEFTLTISSLQPEDFATYYCQQHNKYPYTFGGGTKVEIK |

TABLE 25-continued

Humanized CD123 CAR Constructs

| Name | SEQ ID | Sequence |
|---|---|---|
| hzCAR123-14 NT | 1208 | ATGGCCCTCCCTGTCACCGCCCTGCTGCTTCCGCTGGCTCTTCTGCTCCACGCCGCTCGGCC<br>CGAAGTGGTGCTGACCCAGTCGCCCGCAACCCTCTCTCTGTCGCCGGGAGAACGCGCCACTC<br>TTTCCTGTCGGGCGTCCAAGAGCATCTCAAAGGACCTCGCCTGGTACCAGCAGAAGCCTGGT<br>CAAGCCCCGCGGCTGCTGATCTACTCCGGCTCCACGCTGCAATCAGGAATCCCAGCCAGATT<br>TTCCGGTTCGGGGTCGGGGACTGACTTCACCTTGACCATTAGCTCGCTGGAACCTGAGGACT<br>TCGCCGTGTATTACTGCCAGCAGCACAACAAGTACCCGTACACCTTCGGAGGCGGTACTAAG<br>GTCGAGATCAAGGGGGGTGGCGGTAGCGGAGGAGGGGGCTCCGGCGGCGGCGGCTCAGGGGG<br>CGGAGGAAGCCAAGTGCAGCTGGTGCAGTCAGGCAGCGAACTGAAGAAGCCCGGAGCCTCCG<br>TCAAAGTGTCCTGCAAAGCCTCGGGATACACCTTCACCTTCTACTGGATGAACTGGGTCCGC<br>CAGGCACCTGGACAGGGGCTGGAGTGGATGGGAAGGATCGATCCCTACGATTCCGAAACCCA<br>TTACAATCAGAAGTTCAAGGACCGGTTTGTGTTCTCCGTGGACAAGTCCGTGTCCACCGCCT<br>ACCTCCAAATTAGCAGCCTGAAGGCGGAGGATACAGCTGTCTACTACTGCGCTCGCGGAAAC<br>TGGGATGACTATTGGGGCCAGGGAACTACCGTGACTGTGTCCTCCACCACTACCCCAGCACC<br>GAGGCCACCCACCCCGGCTCCTACCATCGCCTCCCAGCCTCTGTCCCTGCGTCCGGAggcat<br>gtagacccgcagctggtggggccgtgcatacccggggtcttgacttcgcctgcgatatctac<br>atttgggcccctctggctggtacttgcggggtcctgctgctttcactcgtgatcactcttta<br>ctgtaagcgcggtcggaagaagctgctgtacatctttaagcaaccettcatgaggcetgtge<br>agactactcaagaggaggacggctgttcatgccggttcccagaggaggaggaaggcggctgc<br>gaactgcgcgtgaaattcagccgcagcgcagatgctccagcctacaagcaggggcagaacca<br>gctctacaacgaactcaatcttggtcggagagaggagtacgacgtgctggacaagcggagag<br>gacgggacccagaaatgggcgggaagccgcgcagaaagaatccccaagagggcctgtacaac<br>gagctccaaaggataagatggcagaagcctatagcgagattggtatgaaaggggaacgcag<br>aagaggcaaaggccacgacggactgtaccagggactcagcaccgccaccaaggacacctatg<br>acgctcttcacatgcaggccctgccgcctcgg |
| hzCAR123-14 AA | 1209 | MALPVTALLLPLALLLHAARPEVVLTQSPATLSLSPGERATLSCRASKSISKDLAWYQQK<br>PGQAPRLLIYSGSTLQSGIPARFSGSGSGTDFTLTISSLEPEDFAVYYCQQHNKYPYTFG<br>GGTKVEIKGGGGSGGGGSGGGGSGGGGSQVQLVQSGSELKKPGASVKVSCKASGYTFTSY<br>WMNWVRQAPGQGLEWMGRIDPYDSETHYNQKFKDRFVFSVDKSVSTAYLQISSLKAEDTA<br>VYYCARGNWDDYWGQGTTVTVSSTTTPAPRPPTPAPTIASQPLSLRPEACRPAAGGAVHT<br>RGLDFACDIYIWAPLAGTCGVLLLSLVITLYCKRGRKKLLYIFKQPFMRPVQTTQEEDGC<br>SCRFPEEEEGGCELRVKFSRSADAPAYKQGQNQLYNELNLGRREEYDVLDKRRGRDPEMG<br>GKPRRKNPQEGLYNELQKDKMAEAYSEIGMKGERRRGKGHDGLYQGLSTATKDTYDALHM<br>QALPPR |
| hzCAR123-14 scFv | 1210 | MALPVTALLLPLALLLHAARPEVVLTQSPATLSLSPGERATLSCRASKSISKDLAWYQQK<br>PGQAPRLLIYSGSTLQSGIPARFSGSGSGTDFTLTISSLEPEDFAVYYCQQHNKYPYTFG<br>GGTKVEIKGGGGSGGGGSGGGGSGGGGSQVQLVQSGSELKKPGASVKVSCKASGYTFTSY<br>WMNWVRQAPGQGLEWMGRIDPYDSETHYNQKFKDRFVFSVDKSVSTAYLQISSLKAEDTA<br>VYYCARGNWDDYWGQGTTVTVSS |
| hzCAR123-14 VH | 1211 | QVQLVQSGSELKKPGASVKVSCKASGYTFTSYWMNWVRQAPGQGLEWMGRIDPYDSETHYNQ<br>KFKDRFVFSVDKSVSTAYLQISSLKAEDTAVYYCARGNWDDYWGQGTTVTVSS |
| hzCAR123-14 VL | 1212 | EVVLTQSPATLSLSPGERATLSCRASKSISKDLAWYQQKPGQAPRLLIYSGSTLQSGIPARF<br>SGSGSGTDFTLTISSLEPEDFAVYYCQQHNKYPYTFGGGTKVEIK |
| hzCAR123-15 NT | 1213 | ATGGCCCTCCCTGTCACCGCCCTGCTGCTTCCGCTGGCTCTTCTGCTCCACGCCGCTCGGCC<br>CGACGTCGTGATGACCCAGTCACCGGCATTCCTGTCCGTGACTCCCGGGAGAAAAGGTCACA<br>TTACTTGCCGGGCGTCCAAGAGCATCTCCAAGGACCTCGCCTGGTACCAACAGAAGCCGGAC<br>CAGGCCCCTAAGCTGTTGATCTACTCGGGGTCCACCCTTCAATCGGGAGTGCCATCGCGGTT<br>TAGCGGTTCGGGTTCTGGGACCGACTTCACTTTCACCATCTCCTCACTGGAAGCCGAGGATG<br>CCGCCACTTACTACTGTCAGCAGCACAACAAGTATCCGTACACCTTCGGAGGCGGTACCAAA<br>GTGGAGATCAAGGGGGGTGGCGGTAGCGGAGGAGGGGGCTCCGGCGGCGGCGGCTCAGGGGG<br>CGGAGGAAGCCAAGTGCAGCTGGTGCAGTCAGGCAGCGAACTGAAGAAGCCCGGAGCCTCCG<br>TCAAAGTGTCCTGCAAAGCCTCGGGATACACCTTCACCTTCTACTGGATGAACTGGGTCCGC<br>CAGGCACCTGGACAGGGGCTGGAGTGGATGGGAAGGATCGATCCCTACGATTCCGAAACCCA<br>TTACAATCAGAAGTTCAAGGACCGGTTTGTGTTCTCCGTGGACAAGTCCGTGTCCACCGCCT<br>ACCTCCAAATTAGCAGCCTGAAGGCGGAGGATACAGCTGTCTACTACTGCGCTCGCGGAAAC<br>TGGGATGACTATTGGGGCCAGGGAACTACCGTGACTGTGTCCTCCACCACTACCCCAGCACC<br>GAGGCCACCCACCCCGGCTCCTACCATCGCCTCCCAGCCTCTGTCCCTGCGTCCGGAggcat<br>gtagacccgcagctggtggggccgtgcatacccggggtcttgacttcgcctgcgatatctac<br>atttgggcccctctggctggtacttgcggggtcctgctgctttcactcgtgatcactcttta<br>ctgtaagcgcggtcggaagaagctgctgtacatctttaagcaaccettcatgaggcetgtge<br>agactactcaagaggaggacggctgttcatgccggttcccagaggaggaggaaggcggctgc<br>gaactgcgcgtgaaattcagccgcagcgcagatgctccagcctacaagcaggggcagaacca<br>gctctacaacgaactcaatcttggtcggagagaggagtacgacgtgctggacaagcggagag<br>gacgggacccagaaatgggcgggaagccgcgcagaaagaatccccaagagggcctgtacaac<br>gagctccaaaggataagatggcagaagcctatagcgagattggtatgaaaggggaacgcag<br>aagaggcaaaggccacgacggactgtaccagggactcagcaccgccaccaaggacacctatg<br>acgctcttcacatgcaggccctgccgcctcgg |
| hzCAR123-15 AA | 1214 | MALPVTALLLPLALLLHAARPDVVMTQSPAFLSVTPGEKVTITCRASKSISKDLAWYQQK<br>PDQAPKLLIYSGSTLQSGVPSRFSGSGSGTDFTFTISSLEAEDAATYYCQQHNKYPYTFG<br>GGTKVEIKGGGGSGGGGSGGGGSGGGGSQVQLVQSGSELKKPGASVKVSCKASGYTFTSY |

TABLE 25-continued

Humanized CD123 CAR Constructs

| Name | SEQ ID | Sequence |
|---|---|---|
| | | WMNWVRQAPGQGLEWMGRIDPYDSETHYNQKFKDRFVFSVDKSVSTAYLQISSLKAEDTA<br>VYYCARGNWDDYWGQGTTVTVSSTTTPAPRPPTPAPTIASQPLSLRPEACRPAAGGAVHT<br>RGLDFACDIYIWAPLAGTCGVLLLSLVITLYCKRGRKKLLYIFKQPFMRPVQTTQEEDGC<br>SCRFPEEEEGGCELRVKFSRSADAPAYKQGQNQLYNELNLGRREEYDVLDKRRGRDPEMG<br>GKPRRKNPQEGLYNELQKDKMAEAYSEIGMKGERRRGKGHDGLYQGLSTATKDTYDALHM<br>QALPPR |
| hzCAR123-15 scFv | 1215 | MALPVTALLLPLALLLHAARPDVVMTQSPAFLSVTPGEKVTITCRASKSISKDLAWYQQK<br>PDQAPKLLIYSGSTLQSGVPSRFSGSGSGTDFTFTISSLEAEDAATYYCQQHNKYPYTFG<br>GGTKVEIKGGGGSGGGGSGGGGSGGGGSQVQLVQSGSELKKPGASVKVSCKASGYTFTSY<br>WMNWVRQAPGQGLEWMGRIDPYDSETHYNQKFKDRFVFSVDKSVSTAYLQISSLKAEDTA<br>VYYCARGNWDDYWGQGTTVTVSS |
| hzCAR123-15 VH | 1216 | QVQLVQSGSELKKPGASVKVSCKASGYTFTSYWMNWVRQAPGQGLEWMGRIDPYDSETHYNQ<br>KFKDRFVFSVDKSVSTAYLQISSLKAEDTAVYYCARGNWDDYWGQGTTVTVSS |
| hzCAR123-15 VL | 1217 | DVVMTQSPAFLSVTPGEKVTITCRASKSISKDLAWYQQKPDQAPKLLIYSGSTLQSGVPSRF<br>SGSGSGTDFTFTISSLEAEDAATYYCQQHNKYPYTFGGGTKVEIK |
| hzCAR123-16 NT | 1218 | ATGGCCCTCCCTGTCACCGCCCTGCTGCTTCCGCTGGCTCTTCTGCTCCACGCCGCTCGGCC<br>CGACGTGGTCATGACTCAGTCCCCGGACTCACTCGCGGTGTCGCTTGGAGAGAGAGCGACCA<br>TCAACTGTCGGGCCTCAAAGAGCATCAGCAAGGACCTGGCCTGGTACCAGCAGAAGCCGGGA<br>CAGCCGCCAAAGCTGCTGATCTACTCCGGGTCCACCTTGCAATCTGGTGTCCCTGACCGGTT<br>CTCCGGTTCCGGGTCGGGTACCGACTTCACGTTCACTATTTCGTCGCTGCAAGCCGAAGATG<br>CGGCCGTGTACTATTGCCAACAGCACAACAAGTACCCCTACACTTTTGGCGGAGGCACCAAG<br>GTGGAAATCAAGGGGGGTGGCGGTAGCGGAGGAGGGGGCTCCGGCGGCGGCGGCTCAGGGGG<br>CGGAGGAAGCCAAGTGCAGCTGGTGCAGTCAGGCAGCGAACTGAAGAAGCCCGGAGCCTCCG<br>TCAAAGTGTCCTGCAAAGCCTCGGGATACACCTTCACCTCCTACTGGATGAACTGGGTCCGC<br>CAGGCACCTGGACAGGGGCTGGAGTGGATGGGAAGGATCGATCCCTACGATTCCGAAACCCA<br>TTACAATCAGAAGTTCAAGGACCGGTTTGTGTTCTCCGTGGACAAGTCCGTGTCCACCGCCT<br>ACCTCCAAATTAGCAGCCTGAAGGCGGAGGATACAGCTGTCTACTACTGCGCTCGCGGAAAC<br>TGGGATGACTATTGGGGCCAGGGAACTACCGTGACTGTGTCCTCCACCACTACCCCAGCACC<br>GAGGCCACCCACCCCGGCTCCTACCATCGCCTCCCAGCCTCTGTCCCTGCGTCCGGAggcat<br>gtagacccgcagctggtggggccgtgcatacccggggtcttgacttcgcctgcgatatctac<br>atttgggcccctctggctggtacttgcgggtcctgctgctttcactcgtgatcactctttta<br>ctgtaagcgcggtcggaagaagctgctgtacatctttaagcaacccttcatgaggcctgtgc<br>agactactcaagaggaggacggctgttcatgccggttcccagaggaggaggaaggcggctgc<br>gaactgcgcgtgaaattcagccgcagcgcagatgctccagcctacaagcaggggcagaacca<br>gctctacaacgaactcaatcttggtcggagagaggagtacgacgtgctggacaagcggagag<br>gacgggacccagaaatgggcggaagccgcgcagaaagaatccccaagagggcctgtacaac<br>gagctccaaaaggataagatggcagaaagcctatagcgagattggtatgaaaggggaacgcag<br>aagaggcaaaggccacgacggactgtaccagggactcagcaccgccaccaaggacacctatg<br>acgctcttcacatgcaggccctgccgcctcgg |
| hzCAR123-16 AA | 1219 | MALPVTALLLPLALLLHAARPDVVMTQSPDSLAVSLGERATINCRASKSISKDLAWYQQK<br>PGQPPKLLIYSGSTLQSGVPDRFSGSGSGTDFTLTISSLQAEDVAVYYCQQHNKYPYTFG<br>GGTKVEIKGGGGSGGGGSGGGGSGGGGSQVQLVQSGSELKKPGASVKVSCKASGYTFTSY<br>WMNWVRQAPGQGLEWMGRIDPYDSETHYNQKFKDRFVFSVDKSVSTAYLQISSLKAEDTA<br>VYYCARGNWDDYWGQGTTVTVSSTTTPAPRPPTPAPTIASQPLSLRPEACRPAAGGAVHT<br>RGLDFACDIYIWAPLAGTCGVLLLSLVITLYCKRGRKKLLYIFKQPFMRPVQTTQEEDGC<br>SCRFPEEEEGGCELRVKFSRSADAPAYKQGQNQLYNELNLGRREEYDVLDKRRGRDPEMG<br>GKPRRKNPQEGLYNELQKDKMAEAYSEIGMKGERRRGKGHDGLYQGLSTATKDTYDALHM<br>QALPPR |
| hzCAR123-16 scFv | 1220 | MALPVTALLLPLALLLHAARPDVVMTQSPDSLAVSLGERATINCRASKSISKDLAWYQQK<br>PGQPPKLLIYSGSTLQSGVPDRFSGSGSGTDFTLTISSLQAEDVAVYYCQQHNKYPYTFG<br>GGTKVEIKGGGGSGGGGSGGGGSGGGGSQVQLVQSGSELKKPGASVKVSCKASGYTFTSY<br>WMNWVRQAPGQGLEWMGRIDPYDSETHYNQKFKDRFVFSVDKSVSTAYLQISSLKAEDTA<br>VYYCARGNWDDYWGQGTTVTVSS |
| hzCAR123-16 VH | 1221 | QVQLVQSGSELKKPGASVKVSCKASGYTFTSYWMNWVRQAPGQGLEWMGRIDPYDSETHYNQ<br>KFKDRFVFSVDKSVSTAYLQISSLKAEDTAVYYCARGNWDDYWGQGTTVTVSS |
| hzCAR123-16 VL | 1222 | DVVMTQSPDSLAVSLGERATINCRASKSISKDLAWYQQKPGQPPKLLIYSGSTLQSGVPDRF<br>SGSGSGTDFTLTISSLQAEDVAVYYCQQHNKYPYTFGGGTKVEIK |
| hzCAR123-17 NT | 1223 | ATGGCCCTCCCTGTCACCGCCCTGCTGCTTCCGCTGGCTCTTCTGCTCCACGCCGCTCGGCC<br>CGAGGTGCAGCTGGTGCAGAGCGGAGCCGAGGTCAAGAAGCCTGGAGAATCCCTGAGGATCA<br>GCTGCAAAGGCAGCGGGTATACCTTCACCTCCTACTGGATGAATTGGGTCCGCCAGATGCCC<br>GGAAAAGGCCTGGAGTGGATGGGACGGATTGACCCCTACGACTCGGAAACCCATTACAACCA<br>GAAGTTCAAGGATCACGTGACCATCTCCGTGGACAAGTCCATTTCCACTGCGTACCTCCAGT<br>GGTCAAGCCTGAAGGCCTCCGACACTGCTATGTACTACTGCGCACGCGGAAACTGGGATGAT<br>TACTGGGGACAGGGAACAACCGTGACTGTGTCCTCCGGGGGTGGCGGTAGCGGAGGAGGGGG<br>CTCCGGCGGCGGCGGCTCAGGGGGCGGAGGAAGCGACGTGCAGCTCACCCAGTCGCCCTCAT<br>TTCTGTCGGCCTCAGTGGGAGACAGAGTGACCATTACTTGTCGGGCCTCCAAGAGCATCTCC |

TABLE 25-continued

Humanized CD123 CAR Constructs

| Name | SEQ ID | Sequence |
|---|---|---|
| | | AAGGACCTGGCCTGGTATCAGCAGAAGCCAGGAAAGGCGCCTAAGTTGCTCATCTACTCGGG<br>GTCGACCCTGCAATCTGGCGTGCCGTCCCGGTTCTCCGGTTCGGGAAGCGGTACCGAATTCA<br>CCCTTACTATCTCCTCCCTGCAACCGGAGGACTTCGCCACCTACTACTGCCAACAGCACAAC<br>AAGTACCCGTACACTTTCGGGGGTGGCACGAAGGTCGAAATCAAGACCACTACCCCAGCACC<br>GAGGCCACCCACCCCGGCTCCTACCATCGCCTCCCAGCCTCTGTCCCTGCGTCCGGAggcat<br>gtagacccgcagctggtggggccgtgcatacccggggtcttgacttcgcctgcgatatctac<br>atttgggcccctctggctggtacttgcgggtcctgctgcttcactcgtgatcactcttta<br>ctgtaagcgcggtcggaagaagctgctgtacatctttaagcaaccttcatgaggcctgtgc<br>agactactcaagaggaggacggctgttcatgccggttcccagaggaggaggaaggcggctgc<br>gaactgcgcgtgaaattcagccgcagcgcagatgctccagcctacaagcaggggcagaacca<br>gctctacaacgaactcaatcttggtcggagagaggagtacgacgtgctggacaagcggagag<br>gacgggacccagaaatgggcgggaagccgcgcagaaagaatcccaagagggcctgtacaac<br>gagctccaaaaggataagatggcagaagcctatagcgagattggtatgaaaggggaacgcag<br>aagaggcaaaggccacgacggactgtaccagggactcagcaccgccaccaaggacacctatg<br>acgctcttcacatgcaggccctgccgcctcgg |
| hzCAR123-17 AA | 1224 | MALPVTALLLPLALLLHAARPEVQLVQSGAEVKKPGESLRISCKGSGYTFTSYWMNWVRQ<br>MPGKGLEWMGRIDPYDSETHYNQKFKDHVTISVDKSISTAYLQWSSLKASDTAMYYCARG<br>NWDDYWGQGTTVTVSSGGGGSGGGGSGGGGSGGGGSDVQLTQSPSFLSASVGDRVTITCR<br>ASKSISKDLAWYQQKPGKAPKLLIYSGSTLQSGVPSRFSGSGSGTEFTLTISSLQPEDFA<br>TYYCQQHNKYPYTFGGGTKVEIKTTTPAPRPPTPAPTIASQPLSLRPEACRPAAGGAVHT<br>RGLDFACDIYIWAPLAGTCGVLLLSLVITLYCKRGRKKLLYIFKQPFMRPVQTTQEEDGC<br>SCRFPEEEEGGCELRVKFSRSADAPAYKQGQNQLYNELNLGRREEYDVLDKRRGRDPEMG<br>GKPRRKNPQEGLYNELQKDKMAEAYSEIGMKGERRRGKGHDGLYQGLSTATKDTYDALHM<br>QALPPR |
| hzCAR123-17 scFv | 1225 | MALPVTALLLPLALLLHAARPEVQLVQSGAEVKKPGESLRISCKGSGYTFTSYWMNWVRQ<br>MPGKGLEWMGRIDPYDSETHYNQKFKDHVTISVDKSISTAYLQWSSLKASDTAMYYCARG<br>NWDDYWGQGTTVTVSSGGGGSGGGGSGGGGSGGGGSDVQLTQSPSFLSASVGDRVTITCR<br>ASKSISKDLAWYQQKPGKAPKLLIYSGSTLQSGVPSRFSGSGSGTEFTLTISSLQPEDFA<br>TYYCQQHNKYPYTFGGGTKVEIK |
| hzCAR123-17 VH | 1226 | EVQLVQSGAEVKKPGESLRISCKGSGYTFTSYWMNWVRQMPGKGLEWMGRIDPYDSETHYNQ<br>KFKDHVTISVDKSISTAYLQWSSLKASDTAMYYCARGNWDDYWGQGTTVTVSS |
| hzCAR123-17 VL | 1227 | DVQLTQSPSFLSASVGDRVTITCRASKSISKDLAWYQQKPGKAPKLLIYSGSTLQSGVPSRF<br>SGSGSGTEFTLTISSLQPEDFATYYCQQHNKYPYTFGGGTKVEIK |
| hzCAR123-18 NT | 1228 | ATGGCCCTCCCTGTCACCGCCCTGCTGCTTCCGCTGGCTCTTCTGCTCCACGCCGCTCGGCC<br>CGAGGTGCAGCTGGTGCAGAGCGGAGCCGAGGTCAAGAAGCCTGGAGAATCCCTGAGGATCA<br>GCTGCAAAGGCAGCGGGTATACCTTCACCTCCTACTGGATGAATTGGGTCCGCCAGATGCCC<br>GGAAAAGGCCTGGAGTGGATGGGACGGATTGACCCCTACGACTCAGGAAACCCATTACAACCA<br>GAAGTTCAAGGATCACGTGACCATCTCCGTGGACAAGTCCATTTCCACTGCGTACCTCCAGT<br>GGTCAAGCCTGAAGGCCTCCGACACTGCTATGTACTACTGCGCACGCGGAAACTGGGATGAT<br>TACTGGGGACAGGGAACAACCGTGACTGTGTCCTCCGGGGGTGGCGGTAGCGGAGGAGGGGG<br>CTCCGGCGGCGGCGGCTCAGGGGGCGGAGGAAGCGAAGTGGTGCTGACCCAGTCGCCCGCAA<br>CCCTCTCTCTGTCGCCGGGAGAACGCGCCACTCTTTCCTGTCGGGCGTCCAAGAGCATCTCA<br>AAGGACCTCGCCTGGTACCAGCAGAAGCCTGGTCAAGCCCGCGGCTGCTGATCTACTCCGG<br>CTCCACGCTGCAATCAGGAATCCCAGCCAGATTTTCCGGTTCGGGGTCGGGGACTGACTTCA<br>CCTTGACCATTAGCTCGCTGGAACCTGAGGACTTCGCCGTGTATTACTGCCAGCAGCACAAC<br>AAGTACCCGTACACCTTCGGAGGCGGTACTAAGGTCGAGATCAAGACCACTACCCCAGCACC<br>GAGGCCACCCACCCCGGCTCCTACCATCGCCTCCCAGCCTCTGTCCCTGCGTCCGGAggcat<br>gtagacccgcagctggtggggccgtgcatacccggggtcttgacttcgcctgcgatatctac<br>atttgggcccctctggctggtacttgcgggtcctgctgcttcactcgtgatcactcttta<br>ctgtaagcgcggtcggaagaagctgctgtacatctttaagcaaccttcatgaggcctgtgc<br>agactactcaagaggaggacggctgttcatgccggttcccagaggaggaggaaggcggctgc<br>gaactgcgcgtgaaattcagccgcagcgcagatgctccagcctacaagcaggggcagaacca<br>gctctacaacgaactcaatcttggtcggagagaggagtacgacgtgctggacaagcggagag<br>gacgggacccagaaatgggcgggaagccgcgcagaaagaatcccaagagggcctgtacaac<br>gagctccaaaaggataagatggcagaagcctatagcgagattggtatgaaaggggaacgcag<br>aagaggcaaaggccacgacggactgtaccagggactcagcaccgccaccaaggacacctatg<br>acgctcttcacatgcaggccctgccgcctcgg |
| hzCAR123-18 AA | 1229 | MALPVTALLLPLALLLHAARPEVQLVQSGAEVKKPGESLRISCKGSGYTFTSYWMNWVRQ<br>MPGKGLEWMGRIDPYDSETHYNQKFKDHVTISVDKSISTAYLQWSSLKASDTAMYYCARG<br>NWDDYWGQGTTVTVSSGGGGSGGGGSGGGGSGGGGSEVVLTQSPATLSLSPGERATLSCR<br>ASKSISKDLAWYQQKPGQAPRLLIYSGSTLQSGIPARFSGSGSGTDFTLTISSLEPEDFA<br>VYYCQQHNKYPYTFGGGTKVEIKTTTPAPRPPTPAPTIASQPLSLRPEACRPAAGGAVHT<br>RGLDFACDIYIWAPLAGTCGVLLLSLVITLYCKRGRKKLLYIFKQPFMRPVQTTQEEDGC<br>SCRFPEEEEGGCELRVKFSRSADAPAYKQGQNQLYNELNLGRREEYDVLDKRRGRDPEMG<br>GKPRRKNPQEGLYNELQKDKMAEAYSEIGMKGERRRGKGHDGLYQGLSTATKDTYDALHM<br>QALPPR |
| hzCAR123-18 scFv | 1230 | MALPVTALLLPLALLLHAARPEVQLVQSGAEVKKPGESLRISCKGSGYTFTSYWMNWVRQ<br>MPGKGLEWMGRIDPYDSETHYNQKFKDHVTISVDKSISTAYLQWSSLKASDTAMYYCARG |

TABLE 25-continued

Humanized CD123 CAR Constructs

| Name | SEQ ID | Sequence |
|---|---|---|
| | | NWDDYWGQGTTVTVSSGGGGSGGGGSGGGGSGGGGSEVVLTQSPATLSLSPGERATLSCR
ASKSISKDLAWYQQKPGQAPRLLIYSGSTLQSGIPARFSGSGSGTDFTLTISSLEPEDFA
VYYCQQHNKYPYTFGGGTKVEIK |
| hzCAR123-18 VH | 1231 | EVQLVQSGAEVKKPGESLRISCKGSGYTFTSYWMNWVRQMPGKGLEWMGRIDPYDSETHYNQ
KFKDHVTISVDKSISTAYLQWSSLKASDTAMYYCARGNWDDYWGQGTTVTVSS |
| hzCAR123-18 VL | 1232 | EVVLTQSPATLSLSPGERATLSCRASKSISKDLAWYQQKPGQAPRLLIYSGSTLQSGIPARF
SGSGSGTDFTLTISSLEPEDFAVYYCQQHNKYPYTFGGGTKVEIK |
| hzCAR123-19 NT | 1233 | ATGGCCCTCCCTGTCACCGCCCTGCTGCTTCCGCTGGCTCTTCTGCTCCACGCCGCTCGGCC
CGAGGTGCAGCTGGTGCAGAGCGGAGCCGAGGTCAAGAAGCCTGGAGAATCCCTGAGGATCA
GCTGCAAAGGCAGCGGGTATACCTTCACCTCCTACTGGATGAATTGGGTCCGCCAGATGCCC
GGAAAAGGCCTGGAGTGGATGGGACGGATTGACCCCTACGACTCGGAAACCCATTACAACCA
GAAGTTCAAGGATCACGTGACCATCTCCGTGGACAAGTCCATTTCCACTGCGTACCTCCAGT
GGTCAAGCCTGAAGGCCTCCGACACTGCTATGTACTACTGCGCACGCGGAAACTGGGATGAT
TACTGGGGACAGGGAACAACCGTGACTGTGTCCTCCGGGGGTGGCGGTAGCGGAGGAGGGGG
CTCCGGCGGCGGCGGCTCAGGGGGCGGAGGAAGCGACGTCGTGATGACCCAGTCACCGGCAT
TCCTGTCCGTGACTCCCGGAGAAAAGGTCACGATTACTTGCCGGGCGTCCAAGAGCATCTCC
AAGGACCTCGCCTGGTACCAACAGAAGCCGGACCAGGCCCCTAAGCTGTTGATCTACTCGGG
GTCCACCCTTCAATCGGGAGTGCCATCGCGGTTTAGCGGTTCGGGTTCTGGGACCGACTTCA
CTTTCACCATCTCCTCACTGGAAGCCGAGGATGCCGCCACTTACTACTGTCAGCAGCACAAC
AAGTATCCGTACACCTTCGGAGGCGGTACCAAAGTGGAGATCAAGACCACTACCCCAGCACC
GAGGCCACCCACCCCGGCTCCTACCATCGCCTCCCAGCCTCTGTCCCTGCGTCCGGAggcat
gtagacccgcagctggtggggccgtgcataccggggtcttgacttcgcctgcgatatctac
atttgggcccctctggctggtacttgcggggtcctgctgctttcactcgtgatcactcttta
ctgtaagcgcggtcggaagaagctgctgtacatctttaagcaaccttcatgaggcctgtgc
agactactcaagaggaggacggctgttcatgccggttcccagaggaggaggaaggcggctgc
gaactgcgcgtgaaattcagccgcagcgcagatgctccagcctacaagcaggggcagaacca
gctctacaacgaactcaatcttggtcggagagaggagtacgacgtgctggacaagcggagag
gacgggacccagaaatgggcgggaagccgcgcagaaagaatccccaagagggcctgtacaac
gagctccaaaggataagatggcagaagcctatagcgagattggtatgaaggggaacgcag
aagaggcaaaggccacgacggactgtaccagggactcagcaccgccaccaaggacacctatg
acgctcttcacatgcaggccctgccgcctcgg |
| hzCAR123-19 AA | 1234 | MALPVTALLLPLALLLLHAARPEVQLVQSGAEVKKPGESLRISCKGSGYTFTSYWMNWVRQ
MPGKGLEWMGRIDPYDSETHYNQKFKDHVTISVDKSISTAYLQWSSLKASDTAMYYCARG
NWDDYWGQGTTVTVSSGGGGSGGGGSGGGGSGGGGSDVVMTQSPAFLSVTPGEKVTITCR
ASKSISKDLAWYQQKPDQAPKLLIYSGSTLQSGVPSRFSGSGSGTDFTFTISSLEAEDAA
TYYCQQHNKYPYTFGGGTKVEIKTTTPAPRPPTPAPTIASQPLSLRPEACRPAAGGAVHT
RGLDFACDIYIWAPLAGTCGVLLLSLVITLYCKRGRKKLLYIFKQPFMRPVQTTQEEDGC
SCRFPEEEEGGCELRVKFSRSADAPAYKQGQNQLYNELNLGRREEYDVLDKRRGRDPEMG
GKPRRKNPQEGLYNELQKDKMAEAYSEIGMKGERRRGKGHDGLYQGLSTATKDTYDALHM
QALPPR |
| hzCAR123-19 scFv | 1235 | MALPVTALLLPLALLLLHAARPEVQLVQSGAEVKKPGESLRISCKGSGYTFTSYWMNWVRQ
MPGKGLEWMGRIDPYDSETHYNQKFKDHVTISVDKSISTAYLQWSSLKASDTAMYYCARG
NWDDYWGQGTTVTVSSGGGGSGGGGSGGGGSGGGGSDVVMTQSPAFLSVTPGEKVTITCR
ASKSISKDLAWYQQKPDQAPKLLIYSGSTLQSGVPSRFSGSGSGTDFTFTISSLEAEDAA
TYYCQQHNKYPYTFGGGTKVEIK |
| hzCAR123-19 VH | 1236 | EVQLVQSGAEVKKPGESLRISCKGSGYTFTSYWMNWVRQMPGKGLEWMGRIDPYDSETHYNQ
KFKDHVTISVDKSISTAYLQWSSLKASDTAMYYCARGNWDDYWGQGTTVTVSS |
| hzCAR123-19 VL | 1237 | DVVMTQSPAFLSVTPGEKVTITCRASKSISKDLAWYQQKPDQAPKLLIYSGSTLQSGVPSRF
SGSGSGTDFTFTISSLEAEDAATYYCQQHNKYPYTFGGGTKVEIK |
| hzCAR123-20 NT | 1238 | ATGGCCCTCCCTGTCACCGCCCTGCTGCTTCCGCTGGCTCTTCTGCTCCACGCCGCTCGGCC
CGAGGTGCAGCTGGTGCAGAGCGGAGCCGAGGTCAAGAAGCCTGGAGAATCCCTGAGGATCA
GCTGCAAAGGCAGCGGGTATACCTTCACCTCCTACTGGATGAATTGGGTCCGCCAGATGCCC
GGAAAAGGCCTGGAGTGGATGGGACGGATTGACCCCTACGACTCGGAAACCCATTACAACCA
GAAGTTCAAGGATCACGTGACCATCTCCGTGGACAAGTCCATTTCCACTGCGTACCTCCAGT
GGTCAAGCCTGAAGGCCTCCGACACTGCTATGTACTACTGCGCACGCGGAAACTGGGATGAT
TACTGGGGACAGGGAACAACCGTGACTGTGTCCTCCGGGGGTGGCGGTAGCGGAGGAGGGGG
CTCCGGCGGCGGCGGCTCAGGGGGCGGAGGAAGCGACGTGGTCATGACTCAGTCCCCGGACT
CACTCGCGGTGTCGCTTGGAGAGAGAGCGACCATCAACTGTCGGGCCTCAAAGAGCATCAGC
AAGGACCTGGCCTGGTACCAGCAGAAGCCGGGACAGCCGCCAAAGCTGCTGATCTACTCCGG
GTCCACCTTGCAATCTGGTGTCCCTGACCGGTTCTCCGGTTCCGGGTCGGGTACCGACTTCA
CGCTCACTATTTCGTCGCTGCAAGCCGAAGATGTGGCCGTGTACTATTGCCAACAGCACAAC
AAGTACCCCTACACTTTTGGCGAGGCACCAAGGTGGAAATCAAGACCACTACCCCAGCACC
GAGGCCACCCACCCCGGCTCCTACCATCGCCTCCCAGCCTCTGTCCCTGCGTCCGGAggcat
gtagacccgcagctggtggggccgtgcataccggggtcttgacttcgcctgcgatatctac
atttgggcccctctggctggtacttgcggggtcctgctgctttcactcgtgatcactcttta
ctgtaagcgcggtcggaagaagctgctgtacatctttaagcaaccttcatgaggcctgtgc
agactactcaagaggaggacggctgttcatgccggttcccagaggaggaggaaggcggctgc |

TABLE 25-continued

Humanized CD123 CAR Constructs

| Name | SEQ ID | Sequence |
|---|---|---|
| | | gaactgcgcgtgaaattcagccgcagcgcagatgctccagcctacaagcaggggcagaacca gctctacaacgaactcaatcttggtcggagagaggagtacgacgtgctggacaagcggagag acgggacccagaaatgggcgggaagccgcgcagaaagaatccccaagagggcctgtacaac gagctccaaaaggataagatggcagaagcctatagcgagattggtatgaaaggggaacgcag aagaggcaaaggccacgacggactgtaccagggactcagcaccgccaccaaggacacctatg acgctcttcacatgcaggccctgccgcctcgg |
| hzCAR123-20 AA | 1239 | MALPVTALLLPLALLLHAARPEVQLVQSGAEVKKPGESLRISCKGSGYTFTSYWMNWVRQ MPGKGLEWMGRIDPYDSETHYNQKFKDHVTISVDKSISTAYLQWSSLKASDTAMYYCARG NWDDYWGQGTTVTVSSGGGGSGGGGSGGGGSGGGGSDVVMTQSPDSLAVSLGERATINCR ASKSISKDLAWYQQKPGQPPKLLIYSGSTLQSGVPDRFSGSGSGTDFTLTISSLQAEDVA VYYCQQHNKYPYTFGGGTKVEIKTTTPAPRPPTPAPTIASQPLSLRPEACRPAAGGAVHT RGLDFACDIYIWAPLAGTCGVLLLSLVITLYCKRGRKKLLYIFKQPFMRPVQTTQEEDGC SCRFPEEEEGGCELRVKFSRSADAPAYKQGQNQLYNELNLGRREEYDVLDKRRGRDPEMG GKPRRKNPQEGLYNELQKDKMAEAYSEIGMKGERRRGKGHDGLYQGLSTATKDTYDALHM QALPPR |
| hzCAR123-20 scFv | 1240 | MALPVTALLLPLALLLHAARPEVQLVQSGAEVKKPGESLRISCKGSGYTFTSYWMNWVRQ MPGKGLEWMGRIDPYDSETHYNQKFKDHVTISVDKSISTAYLQWSSLKASDTAMYYCARG NWDDYWGQGTTVTVSSGGGGSGGGGSGGGGSGGGGSDVVMTQSPDSLAVSLGERATINCR ASKSISKDLAWYQQKPGQPPKLLIYSGSTLQSGVPDRFSGSGSGTDFTLTISSLQAEDVA VYYCQQHNKYPYTFGGGTKVEIK |
| hzCAR123-20 VH | 1241 | EVQLVQSGAEVKKPGESLRISCKGSGYTFTSYWMNWVRQMPGKGLEWMGRIDPYDSETHYNQ KFKDHVTISVDKSISTAYLQWSSLKASDTAMYYCARGNWDDYWGQGTTVTVSS |
| hzCAR123-20 VL | 1242 | DVVMTQSPDSLAVSLGERATINCRASKSISKDLAWYQQKPGQPPKLLIYSGSTLQSGVPDRF SGSGSGTDFTLTISSLQAEDVAVYYCQQHNKYPYTFGGGTKVEIK |
| hzCAR123-21 NT | 1243 | ATGGCCCTCCCTGTCACCGCCCTGCTGCTTCCGCTGGCTCTTCTGCTCCACGCCGCTCGGCC CGACGTGCAGCTCACCCAGTCGCCCTCATTTCTGTCGGCCTCAGTGGGAGACAGAGTGACCA TTACTTGTCGGGCCTCCAAGAGCATCTCCAAGGACCTGGCCTGGTATCAGCAGAAGCCAGGA AAGGCGCCTAAGTTGCTCATCTACTCGGGGTCGACCCTGCAATCTGGCGTGCCGTCCCGGTT CTCCGGTTCGGGAAGCGGTACCGAATTCACCCTTACTATCTCCTCCCTGCAACCGGAGGACT TCGCCACCTACTACTGCCAACAGCACAACAAGTACCCGTACACTTTCGGGGGTGGCACGAAG GTCGAAATCAAGGGGGGTGGCGGTAGCGGAGGAGGGGGCTCCGGCGGCGGCGGCTCAGGGGG CGGAGGAAGCGAGGTGCAGCTGGTGCAGAGCGGAGCCGAGGTCAAGAAGCCTGGAGAATCCC TGAGGATCAGCTGCAAAGGCAGCGGGTATACCTTCACCTCCTACTGGATGAATTGGGTCCGC CAGATGCCCGGAAAAGGCCTGGAGTGGATGGGACGGATTGACCCCTACGACTCGGAAACCCA TTACAACCAGAAGTTCAAGGATCACGTGACCATCTCCGTGGACAAGTCCATTTCCACTGCGT ACCTCCAGTGGTCAAGCCTGAAGGCCTCCGACACTGCTATGTACTACTGCGCACGCGGAAAC TGGGATGATTACTGGGGACAGGGAACAACCGTGACTGTGTCCTCCACCACTACCCCAGCACC GAGGCCACCCACCCCGGCTCCTACCATCGCCTCCCAGCCTCTGTCCCTGCGTCCGGAggcat gtagacccgcagctggtggggccgtgcataccggggtcttgacttcgcctgcgatatctac atttgggcccctctggctggtacttgcggggtcctgctgcttttcactcgtgatcactcttta ctgtaagcgcggtcggaagaagctgctgtacatcttttaagcaaccctccatgaggcctgtgc agactactcaagaggaggacggctgttcatgccggttcccagaggaggaggaaggcggctgc gaactgcgcgtgaaattcagccgcagcgcagatgctccagcctacaagcaggggcagaacca gctctacaacgaactcaatcttggtcggagagaggagtacgacgtgctggacaagcggagag acgggacccagaaatgggcgggaagccgcgcagaaagaatccccaagagggcctgtacaac gagctccaaaaggataagatggcagaagcctatagcgagattggtatgaaaggggaacgcag aagaggcaaaggccacgacggactgtaccagggactcagcaccgccaccaaggacacctatg acgctcttcacatgcaggccctgccgcctcgg |
| hzCAR123-21 AA | 1244 | MALPVTALLLPLALLLHAARPDVQLTQSPSFLSASVGDRVTITCRASKSISKDLAWYQQK PGKAPKLLIYSGSTLQSGVPSRFSGSGSGTEFTLTISSLQPEDFATYYCQQHNKYPYTFG GGTKVEIKGGGGSGGGGSGGGGSGGGGSEVQLVQSGAEVKKPGESLRISCKGSGYTFTSY WMNWVRQMPGKGLEWMGRIDPYDSETHYNQKFKDHVTISVDKSISTAYLQWSSLKASDTA MYYCARGNWDDYWGQGTTVTVSSTTTPAPRPPTPAPTIASQPLSLRPEACRPAAGGAVHT RGLDFACDIYIWAPLAGTCGVLLLSLVITLYCKRGRKKLLYIFKQPFMRPVQTTQEEDGC SCRFPEEEEGGCELRVKFSRSADAPAYKQGQNQLYNELNLGRREEYDVLDKRRGRDPEMG GKPRRKNPQEGLYNELQKDKMAEAYSEIGMKGERRRGKGHDGLYQGLSTATKDTYDALHM QALPPR |
| hzCAR123-21 scFv | 1245 | MALPVTALLLPLALLLHAARPDVQLTQSPSFLSASVGDRVTITCRASKSISKDLAWYQQK PGKAPKLLIYSGSTLQSGVPSRFSGSGSGTEFTLTISSLQPEDFATYYCQQHNKYPYTFG GGTKVEIKGGGGSGGGGSGGGGSGGGGSEVQLVQSGAEVKKPGESLRISCKGSGYTFTSY WMNWVRQMPGKGLEWMGRIDPYDSETHYNQKFKDHVTISVDKSISTAYLQWSSLKASDTA MYYCARGNWDDYWGQGTTVTVSS |
| hzCAR123-21 VH | 1246 | EVQLVQSGAEVKKPGESLRISCKGSGYTFTSYWMNWVRQMPGKGLEWMGRIDPYDSETHYNQ KFKDHVTISVDKSISTAYLQWSSLKASDTAMYYCARGNWDDYWGQGTTVTVSS |
| hzCAR123-21 VL | 1247 | DVQLTQSPSFLSASVGDRVTITCRASKSISKDLAWYQQKPGKAPKLLIYSGSTLQSGVPSRF SGSGSGTEFTLTISSLQPEDFATYYCQQHNKYPYTFGGGTKVEIK |

TABLE 25-continued

Humanized CD123 CAR Constructs

| Name | SEQ ID | Sequence |
|---|---|---|
| hzCAR123-22 NT | 1248 | ATGGCCCTCCCTGTCACCGCCCTGCTGCTTCCGCTGGCTCTTCTGCTCCACGCCGCTCGGCC<br>CGAAGTGGTGCTGACCCAGTCGCCCGCAACCCTCTCTCTGTCGCCGGGAGAACGCGCCACTC<br>TTTCCTGTCGGGCGTCCAAGAGCATCTCAAAGGACCTCGCCTGGTACCAGCAGAAGCCTGGT<br>CAAGCCCCGCGGCTGCTGATCTACTCCGGCTCCACGCTGCAATCAGGAATCCCAGCCAGATT<br>TTCCGGTTCGGGGTCGGGGACTGACTTCACCTTGACCATTAGCTCGCTGGAACCTGAGGACT<br>TCGCCGTGTATTACTGCCAGCAGCACAACAAGTACCCGTACACCTTCGGAGGCGGTACTAAG<br>GTCGAGATCAAGGGGGGTGGCGGTAGCGGAGGAGGGGGCTCCGGCGGCGGCGGCTCAGGGGG<br>CGGAGGAAGCGAGGTGCAGCTGGTGCAGAGCGGAGCCGAGGTCAAGAAGCCTGGAGAATCCC<br>TGAGGATCAGCTGCAAAGGCAGCGGGTATACCTTCACCTCCTACTGGATGAATTGGGTCCGC<br>CAGATGCCCGGAAAAGGCCTGGAGTGGATGGGACGGATTGACCCCTACGACTCGGAAACCCA<br>TTACAACCAGAAGTTCAAGGATCACGTGACCATCTCCGTGGACAAGTCCATTTCCACTGCGT<br>ACCTCCAGTGGTCAAGCCTGAAGGCCTCCGACACTGCTATGTACTACTGCGCACGCGGAAAC<br>TGGGATGATTACTGGGGACAGGGAACAACCGTGACTGTGTCCTCCACCACTACCCCAGCACC<br>GAGGCCACCCACCCCGGCTCCTACCATCGCCTCCCAGCCTCTGTCCCTGCGTCCGGAggcat<br>gtagacccgcagctggtggggccgtgcatacccggggtcttgacttcgcctgcgatatctac<br>atttgggcccctctggctggtacttgcggggtcctgctgctgctttcactcgtgatcactctttta<br>ctgtaagcgcggtcggaagaagctgctgtacatctttaagcaaccccttcatgaggcctgtgc<br>agactactcaagaggaggacggctgttcatgccggttcccagaggaggaggaaggcggctgc<br>gaactgcgcgtgaaattcagccgcagcgcagatgctccagcctacaagcaggggcagaacca<br>gctctacaacgaactcaatcttggtcggagagaggagtacgacgtgctggacaagcggagag<br>gacgggacccagaaatgggcggaagccgcgcagaaagaatccccaagagggcctgtacaac<br>gagctccaaaaggataagatggcagaagcctatagcgagattggtatgaaaggggaacgcag<br>aagaggcaaaggccacgacggactgtaccagggactcagcaccgccaccaaggacacctatg<br>acgctcttcacatgcaggccctgccgcctcgg |
| hzCAR123-22 AA | 1249 | MALPVTALLLPLALLLHAARPEVVLTQSPATLSLSPGERATLSCRASKSISKDLAWYQQK<br>PGQAPRLLIYSGSTLQSGIPARFSGSGSGTDFTLTISSLEPEDFAVYYCQQHNKYPYTFG<br>GGTKVEIKGGGGSGGGGSGGGGSGGGGSEVQLVQSGAEVKKPGESLRISCKGSGYTFTSY<br>WMNWVRQMPGKGLEWMGRIDPYDSETHYNQKFKDHVTISVDKSISTAYLQWSSLKASDTA<br>MYYCARGNWDDYWGQGTTVTVSSTTTPAPRPPTPAPTIASQPLSLRPEACRPAAGGAVHT<br>RGLDFACDIYIWAPLAGTCGVLLLSLVITLYCKRGRKKLLYIFKQPFMRPVQTTQEEDGC<br>SCRFPEEEEGGCELRVKFSRSADAPAYKQGQNQLYNELNLGRREEYDVLDKRRGRDPEMG<br>GKPRRKNPQEGLYNELQKDKMAEAYSEIGMKGERRRGKGHDGLYQGLSTATKDTYDALHM<br>QALPPR |
| hzCAR123-22 scFv | 1250 | MALPVTALLLPLALLLHAARPEVVLTQSPATLSLSPGERATLSCRASKSISKDLAWYQQK<br>PGQAPRLLIYSGSTLQSGIPARFSGSGSGTDFTLTISSLEPEDFAVYYCQQHNKYPYTFG<br>GGTKVEIKGGGGSGGGGSGGGGSGGGGSEVQLVQSGAEVKKPGESLRISCKGSGYTFTSY<br>WMNWVRQMPGKGLEWMGRIDPYDSETHYNQKFKDHVTISVDKSISTAYLQWSSLKASDTA<br>MYYCARGNWDDYWGQGTTVTVSS |
| hzCAR123-22 VH | 1251 | EVQLVQSGAEVKKPGESLRISCKGSGYTFTSYWMNWVRQMPGKGLEWMGRIDPYDSETHYNQ<br>KFKDHVTISVDKSISTAYLQWSSLKASDTAMYYCARGNWDDYWGQGTTVTVSS |
| hzCAR123-22 VL | 1252 | EVVLTQSPATLSLSPGERATLSCRASKSISKDLAWYQQKPGQAPRLLIYSGSTLQSGIPARF<br>SGSGSGTDFTLTISSLEPEDFAVYYCQQHNKYPYTFGGGTKVEIK |
| hzCAR123-23 NT | 1253 | ATGGCCCTCCCTGTCACCGCCCTGCTGCTTCCGCTGGCTCTTCTGCTCCACGCCGCTCGGCC<br>CGACGTCGTGATGACCCAGTCACCGGCATTCCTGTCCGTGACTCCCGGAGAAAAGGTCACCA<br>TTACTTGCCGGGCGTCCAAGAGCATCTCCAAGGACCTCGCCTGGTACCAACAGAAGCCGGAC<br>CAGGCCCCTAAGCTGTTGATCTACTCGGGGTCCACCCTTCAATGGGAGTGCCATCGCGGTT<br>TAGCGGTTCGGGTTCTGGGACCGACTTCACTTTCACCATCTCCTCACTGGAAGCCGAGGATG<br>CCGCCACTTACTACTGTCAGCAGCACAACAAGTATCCGTACACCTTCGGAGGCGGTACCAAA<br>GTGGAGATCAAGGGGGGTGGCGGTAGCGGAGGAGGGGGCTCCGGCGGCGGCGGCTCAGGGGG<br>CGGAGGAAGCGAGGTGCAGCTGGTGCAGAGCGGAGCCGAGGTCAAGAAGCCTGGAGAATCCC<br>TGAGGATCAGCTGCAAAGGCAGCGGGTATACCTTCACCTCCTACTGGATGAATTGGGTCCGC<br>CAGATGCCCGGAAAAGGCCTGGAGTGGATGGGACGGATTGACCCCTACGACTCGGAAACCCA<br>TTACAACCAGAAGTTCAAGGATCACGTGACCATCTCCGTGGACAAGTCCATTTCCACTGCGT<br>ACCTCCAGTGGTCAAGCCTGAAGGCCTCCGACACTGCTATGTACTACTGCGCACGCGGAAAC<br>TGGGATGATTACTGGGGACAGGGAACAACCGTGACTGTGTCCTCCACCACTACCCCAGCACC<br>GAGGCCACCCACCCCGGCTCCTACCATCGCCTCCCAGCCTCTGTCCCTGCGTCCGGAggcat<br>gtagacccgcagctggtggggccgtgcatacccggggtcttgacttcgcctgcgatatctac<br>atttgggcccctctggctggtacttgcggggtcctgctgctgctttcactcgtgatcactctttta<br>ctgtaagcgcggtcggaagaagctgctgtacatctttaagcaaccccttcatgaggcctgtgc<br>agactactcaagaggaggacggctgttcatgccggttcccagaggaggaggaaggcggctgc<br>gaactgcgcgtgaaattcagccgcagcgcagatgctccagcctacaagcaggggcagaacca<br>gctctacaacgaactcaatcttggtcggagagaggagtacgacgtgctggacaagcggagag<br>gacgggacccagaaatgggcggaagccgcgcagaaagaatccccaagagggcctgtacaac<br>gagctccaaaaggataagatggcagaagcctatagcgagattggtatgaaaggggaacgcag<br>aagaggcaaaggccacgacggactgtaccagggactcagcaccgccaccaaggacacctatg<br>acgctcttcacatgcaggccctgccgcctcgg |
| hzCAR123-23 AA | 1254 | MALPVTALLLPLALLLHAARPDVVMTQSPAFLSVTPGEKVTITCRASKSISKDLAWYQQK<br>PDQAPKLLIYSGSTLQSGVPSRFSGSGSGTDFTFTISSLEAEDAATYYCQQHNKYPYTFG<br>GGTKVEIKGGGGSGGGGSGGGGSGGGGSEVQLVQSGAEVKKPGESLRISCKGSGYTFTSY |

TABLE 25-continued

Humanized CD123 CAR Constructs

| Name | SEQ ID | Sequence |
|---|---|---|
| | | WMNWVRQMPGKGLEWMGRIDPYDSETHYNQKFKDHVTISVDKSISTAYLQWSSLKASDTA<br>MYYCARGNWDDYWGQGTTVTVSSTTTPAPRPPTPAPTIASQPLSLRPEACRPAAGGAVHT<br>RGLDFACDIYIWAPLAGTCGVLLLSLVITLYCKRGRKKLLYIFKQPFMRPVQTTQEEDGC<br>SCRFPEEEEGGCELRVKFSRSADAPAYKQGQNQLYNELNLGRREEYDVLDKRRGRDPEMG<br>GKPRRKNPQEGLYNELQKDKMAEAYSEIGMKGERRRGKGHDGLYQGLSTATKDTYDALHM<br>QALPPR |
| hzCAR123-23<br>scFv | 1255 | MALPVTALLLPLALLLHAARPDVVMTQSPAFLSVTPGEKVTITCRASKSISKDLAWYQQK<br>PDQAPKLLIYSGSTLQSGVPSRFSGSGSGTDFTFTISSLEAEDAATYYCQQHNKYPYTFG<br>GGTKVEIKGGGGSGGGGSGGGGSGGGGSEVQLVQSGAEVKKPGESLRISCKGSGYTFTSY<br>WMNWVRQMPGKGLEWMGRIDPYDSETHYNQKFKDHVTISVDKSISTAYLQWSSLKASDTA<br>MYYCARGNWDDYWGQGTTVTVSS |
| hzCAR123-23<br>VH | 1256 | EVQLVQSGAEVKKPGESLRISCKGSGYTFTSYWMNWVRQMPGKGLEWMGRIDPYDSETHYNQ<br>KFKDHVTISVDKSISTAYLQWSSLKASDTAMYYCARGNWDDYWGQGTTVTVSS |
| hzCAR123-23<br>VL | 1257 | DVVMTQSPAFLSVTPGEKVTITCRASKSISKDLAWYQQKPDQAPKLLIYSGSTLQSGVPSRF<br>SGSGSGTDFTFTISSLEAEDAATYYCQQHNKYPYTFGGGTKVEIK |
| hzCAR123-24<br>NT | 1258 | ATGGCCCTCCCTGTCACCGCCCTGCTGCTTCCGCTGGCTCTTCTGCTCCACGCCGCTCGGCC<br>CGACGTGGTCATGACTCAGTCCCCGGACTCACTCGCGGTGTCGCTTGGAGAGAGAGCGACCA<br>TCAACTGTCGGGCCTCAAAGAGCATCAGCAAGGACCTGGCCTGGTACCAGCAGAAGCCGGGA<br>CAGCCGCCAAAGCTGCTGATCTACTCCGGGTCCACCTTGCAATCTGGTGTCCCTGACCGGTT<br>CTCCGGTTCCGGGTCGGGTACCGACTTCACGCTCACTATTTCGTCGCTGCAAGCCGAAGATG<br>TGGCCGTGTACTATTGCCAACAGCACAACAAGTACCCCTACACTTTTGGCGGAGGCACCAAG<br>GTGGAAATCAAGGGGGGTGGCGGTAGCGGAGGAGGGGGCTCCGGCGGCGGCGGCTCAGGGGG<br>CGGAGGAAGCGAGGTGCAGCTGGTGCAGAGCGGAGCCGAGGTCAAGAAGCCTGGAGAATCCC<br>TGAGGATCAGCTGCAAAGGCAGCGGGTATACCTTCACCTCCTACTGGATGAATTGGGTCCGC<br>CAGATGCCCGGAAAAGGCCTGGAGTGGATGGGACGGATTGACCCCTACGACTCGGAAACCCA<br>TTACAACCAGAAGTTCAAGGATCACGTGACCATCTCCGTGGACAAGTCCATTTCCACTGCGT<br>ACCTCCAGTGGTCAAGCCTGAAGGCCTCCGACACTGCTATGTACTACTGCGCACGCGGAAAC<br>TGGGATGATTACTGGGGACAGGGAACAACCGTGACTGTGTCCTCCACCACTACCCCAGCACC<br>GAGGCCACCCACCCCGGCTCCTACCATCGCCTCCCAGCCTCTGTCCCTGCGTCCGGAggcat<br>gtagacccgcagctggtggggccgtgcatacccggggtcttgacttcgcctgcgatatctac<br>atttgggcccctctggctggtacttgcgggtcctgctgctttcactcgtgatcactctta<br>ctgtaagcgcggtcggaagaagctgctgtacatctttaagcaacccttcatgaggcctgtgc<br>agactactcaagaggaggacggctgttcatgccggttcccagaggaggaggaaggcggctgc<br>gaactgcgcgtgaaattcagccgcagcgcagatgctccagcctacaagcaggggcagaacca<br>gctctacaacgaactcaatcttggtcggagagaggagtacgacgtgctggacaagcggagag<br>gacgggacccagaaatgggcgggaagccgcgcagaaagaatccccaagagggcctgtacaac<br>gagctccaaaaggataagatggcagaagcctatagcgagattggtatgaaggggaacgcag<br>aagaggcaaaggccacgacggactgtaccagggactcagcaccgccaccaaggacacctatg<br>acgctcttcacatgcaggccctgccgcctcgg |
| hzCAR123-24<br>AA | 1259 | MALPVTALLLPLALLLHAARPDVVMTQSPDSLAVSLGERATINCRASKSISKDLAWYQQK<br>PGQPPKLLIYSGSTLQSGVPDRFSGSGSGTDFTLTISSLQAEDVAVYYCQQHNKYPYTFG<br>GGTKVEIKGGGGSGGGGSGGGGSGGGGSEVQLVQSGAEVKKPGESLRISCKGSGYTFTSY<br>WMNWVRQMPGKGLEWMGRIDPYDSETHYNQKFKDHVTISVDKSISTAYLQWSSLKASDTA<br>MYYCARGNWDDYWGQGTTVTVSSTTTPAPRPPTPAPTIASQPLSLRPEACRPAAGGAVHT<br>RGLDFACDIYIWAPLAGTCGVLLLSLVITLYCKRGRKKLLYIFKQPFMRPVQTTQEEDGC<br>SCRFPEEEEGGCELRVKFSRSADAPAYKQGQNQLYNELNLGRREEYDVLDKRRGRDPEMG<br>GKPRRKNPQEGLYNELQKDKMAEAYSEIGMKGERRRGKGHDGLYQGLSTATKDTYDALHM<br>QALPPR |
| hzCAR123-24<br>scFv | 1260 | MALPVTALLLPLALLLHAARPDVVMTQSPDSLAVSLGERATINCRASKSISKDLAWYQQK<br>PGQPPKLLIYSGSTLQSGVPDRFSGSGSGTDFTLTISSLQAEDVAVYYCQQHNKYPYTFG<br>GGTKVEIKGGGGSGGGGSGGGGSGGGGSEVQLVQSGAEVKKPGESLRISCKGSGYTFTSY<br>WMNWVRQMPGKGLEWMGRIDPYDSETHYNQKFKDHVTISVDKSISTAYLQWSSLKASDTA<br>MYYCARGNWDDYWGQGTTVTVSS |
| hzCAR123-24<br>VH | 1261 | EVQLVQSGAEVKKPGESLRISCKGSGYTFTSYWMNWVRQMPGKGLEWMGRIDPYDSETHYNQ<br>KFKDHVTISVDKSISTAYLQWSSLKASDTAMYYCARGNWDDYWGQGTTVTVSS |
| hzCAR123-24<br>VL | 1262 | DVVMTQSPDSLAVSLGERATINCRASKSISKDLAWYQQKPGQPPKLLIYSGSTLQSGVPDRF<br>SGSGSGTDFTLTISSLQAEDVAVYYCQQHNKYPYTFGGGTKVEIK |
| hzCAR123-25<br>NT | 1263 | ATGGCCCTCCCTGTCACCGCCCTGCTGCTTCCGCTGGCTCTTCTGCTCCACGCCGCTCGGCC<br>CGAAGTGCAGCTCGTCGAGAGCGGAGGGGGACTGGTGCAGCCCGGAGGAAGCCTGAGGCTGT<br>CCTGCGCTGCCTCCGGCTACACCTTCACCTCCTACTGGATGAACTGGGTCAGACAGGCACCT<br>GGAAAGGGACTGGTCTGGGTGTCGCGCATTGACCCTACGACTCCGAAACCCATTACAATCA<br>GAAATTCAAGGACCGCTTCACCATCTCCGTGGACAAAGCCAAGAGCACCGCGTACCTCCAAA<br>TGAACTCCCTGCGCGCTGAGGATACAGCAGTGTACTATTGCGCCCGGGGAAACTGGGATGAT<br>TACTGGGGCCAGGGAACTACTGTGACTGTGTCATCCGGGGTGGCGGTAGCGGAGGAGGGGG<br>CTCCGGCGGCGGCGGCTCAGGGGGCGGAGGAAGCGACGTGCAGCTCACCCAGTCGCCCTCAT<br>TTCTGTCGGCCTCAGTGGGAGACAGAGTGACCATTACTTGTCGGGCCTCCAAGAGCATCTCC |

TABLE 25-continued

Humanized CD123 CAR Constructs

| Name | SEQ ID | Sequence |
|---|---|---|
| | | AAGGACCTGGCCTGGTATCAGCAGAAGCCAGGAAAGGCGCCTAAGTTGCTCATCTACTCGGG<br>GTCGACCCTGCAATCTGGCGTGCCGTCCCGGTTCTCCGGTTCGGGAAGCGGTACCGAATTCA<br>CCCTTACTATCTCCTCCCTGCAACCGGAGGACTTCGCCACCTACTACTGCCAACAGCACAAC<br>AAGTACCCGTACACTTTCGGGGGTGGCACGAAGGTCGAAATCAAGACCACTACCCCAGCACC<br>GAGGCCACCCACCCCGGCTCCTACCATCGCCTCCCAGCCTCTGTCCCTGCGTCCGGAggcat<br>gtagacccgcagctggtggggccgtgcatacccggggtcttgacttcgcctgcgatatctac<br>atttgggcccctctggctggtacttgcgggtcctgctgctttcactcgtgatcactctta<br>ctgtaagcgcggtcggaagaagctgctgtacatctttaagcaaccttcatgaggcctgtgc<br>agactactcaagaggaggacggctgttcatgccggttcccagaggaggaggaaggcggctgc<br>gaactgcgcgtgaaattcagccgcagcgcagatgctccagcctacaagcaggggcagaacca<br>gctctacaacgaactcaatcttggtcggagagaggagtacgacgtgctggacaagcggagag<br>gacgggacccagaaatgggcgggaagccgcgcagaaagaatcccaagagggcctgtacaac<br>gagctccaaaaggataagatggcagaagcctatagcgagattggtatgaaaggggaacgcag<br>aagaggcaaaggccacgacggactgtaccagggactcagcaccgccaccaaggacacctatg<br>acgctcttcacatgcaggccctgccgcctcgg |
| hzCAR123-25 AA | 1264 | MALPVTALLLPLALLLHAARPEVQLVESGGGLVQPGGSLRLSCAASGYTFTSYWMNWVRQ<br>APGKGLVWVSRIDPYDSETHYNQKFKDRFTISVDKAKSTAYLQMNSLRAEDTAVYYCARG<br>NWDDYWGQGTTVTVSSGGGGSGGGGSGGGGSGGGGSDVQLTQSPSFLSASVGDRVTITCR<br>ASKSISKDLAWYQQKPGKAPKLLIYSGSTLQSGVPSRFSGSGSGTEFTLTISSLQPEDFA<br>TYYCQQHNKYPYTFGGGTKVEIKTTTPAPRPPTPAPTIASQPLSLRPEACRPAAGGAVHT<br>RGLDFACDIYIWAPLAGTCGVLLLSLVITLYCKRGRKKLLYIFKQPFMRPVQTTQEEDGC<br>SCRFPEEEEGGCELRVKFSRSADAPAYKQGQNQLYNELNLGRREEYDVLDKRRGRDPEMG<br>GKPRRKNPQEGLYNELQKDKMAEAYSEIGMKGERRRGKGHDGLYQGLSTATKDTYDALHM<br>QALPPR |
| hzCAR123-25 scFv | 1265 | MALPVTALLLPLALLLHAARPEVQLVESGGGLVQPGGSLRLSCAASGYTFTSYWMNWVRQ<br>APGKGLVWVSRIDPYDSETHYNQKFKDRFTISVDKAKSTAYLQMNSLRAEDTAVYYCARG<br>NWDDYWGQGTTVTVSSGGGGSGGGGSGGGGSGGGGSDVQLTQSPSFLSASVGDRVTITCR<br>ASKSISKDLAWYQQKPGKAPKLLIYSGSTLQSGVPSRFSGSGSGTEFTLTISSLQPEDFA<br>TYYCQQHNKYPYTFGGGTKVEIK |
| hzCAR123-25 VH | 1266 | EVQLVESGGGLVQPGGSLRLSCAASGYTFTSYWMNWVRQAPGKGLVWVSRIDPYDSETHYNQ<br>KFKDRFTISVDKAKSTAYLQMNSLRAEDTAVYYCARGNWDDYWGQGTTVTVSS |
| hzCAR123-25 VL | 1267 | DVQLTQSPSFLSASVGDRVTITCRASKSISKDLAWYQQKPGKAPKLLIYSGSTLQSGVPSRF<br>SGSGSGTEFTLTISSLQPEDFATYYCQQHNKYPYTFGGGTKVEIK |
| hzCAR123-26 NT | 1268 | ATGGCCCTCCCTGTCACCGCCCTGCTGCTTCCGCTGGCTCTTCTGCTCCACGCCGCTCGGCC<br>CGAAGTGCAGCTCGTCGAGAGCGGAGGGGGACTGGTGCAGCCCGGAGGAAGCCTGAGGCTGT<br>CCTGCGCTGCCTCCGGCTACACCTTCACCTCCTACTGGATGAACTGGGTCAGACAGGCACCT<br>GGAAAGGGACTGGTCTGGGTGTCGCGCATTGACCCCTACGACTCCGAAACCCATTACAATCA<br>GAAATTCAAGGACCGCTTCACCATCTCCGTGGACAAAGCCAAGAGCACCGCGTACCTCCAAA<br>TGAACTCCCTGCGCGCTGAGGATACAGCAGTGTACTATTGCGCCCGGGGAAACTGGGATGAT<br>TACTGGGGACAGGGAACTACTGTGACTGTGTCATCCGGGGGTGGCGGTAGCGGAGGAGGGGG<br>CTCCGGCGGCGGCGGCTCAGGGGGCGGAGGAAGCGAAGTGGTGCTGACCCAGTCGCCCGCAA<br>CCCTCTCTCTGTCGCCGGGAGAACGCGCCACTCTTTCCTGTCGGGCGTCCAAGAGCATCTCA<br>AAGGACCTCGCCTGGTACCAGCAGAAGCCTGGTCAAGCCCGCGGCTGCTGATCTACTCCGG<br>CTCCACGCTGCAATCAGGAATCCCAGCCAGATTTTCCGGTTCGGGGTCGGGGACTGACTTCA<br>CCTTGACCATTAGCTCGCTGGAACCTGAGGACTTCGCCGTGTATTACTGCCAGCAGCACAAC<br>AAGTACCCGTACACCTTCGGAGGCGGTACTAAGGTCGAGATCAAGACCACTACCCCAGCACC<br>GAGGCCACCCACCCCGGCTCCTACCATCGCCTCCCAGCCTCTGTCCCTGCGTCCGGAggcat<br>gtagacccgcagctggtggggccgtgcatacccggggtcttgacttcgcctgcgatatctac<br>atttgggcccctctggctggtacttgcgggtcctgctgctttcactcgtgatcactctta<br>ctgtaagcgcggtcggaagaagctgctgtacatctttaagcaaccttcatgaggcctgtgc<br>agactactcaagaggaggacggctgttcatgccggttcccagaggaggaggaaggcggctgc<br>gaactgcgcgtgaaattcagccgcagcgcagatgctccagcctacaagcaggggcagaacca<br>gctctacaacgaactcaatcttggtcggagagaggagtacgacgtgctggacaagcggagag<br>gacgggacccagaaatgggcgggaagccgcgcagaaagaatcccaagagggcctgtacaac<br>gagctccaaaaggataagatggcagaagcctatagcgagattggtatgaaaggggaacgcag<br>aagaggcaaaggccacgacggactgtaccagggactcagcaccgccaccaaggacacctatg<br>acgctcttcacatgcaggccctgccgcctcgg |
| hzCAR123-26 AA | 1269 | MALPVTALLLPLALLLHAARPEVQLVESGGGLVQPGGSLRLSCAASGYTFTSYWMNWVRQ<br>APGKGLVWVSRIDPYDSETHYNQKFKDRFTISVDKAKSTAYLQMNSLRAEDTAVYYCARG<br>NWDDYWGQGTTVTVSSGGGGSGGGGSGGGGSGGGGSEVVLTQSPATLSLSPGERATLSCR<br>ASKSISKDLAWYQQKPGQAPRLLIYSGSTLQSGIPARFSGSGSGTDFTLTISSLEPEDFA<br>VYYCQQHNKYPYTFGGGTKVEIKTTTPAPRPPTPAPTIASQPLSLRPEACRPAAGGAVHT<br>RGLDFACDIYIWAPLAGTCGVLLLSLVITLYCKRGRKKLLYIFKQPFMRPVQTTQEEDGC<br>SCRFPEEEEGGCELRVKFSRSADAPAYKQGQNQLYNELNLGRREEYDVLDKRRGRDPEMG<br>GKPRRKNPQEGLYNELQKDKMAEAYSEIGMKGERRRGKGHDGLYQGLSTATKDTYDALHM<br>QALPPR |
| hzCAR123-26 scFv | 1270 | MALPVTALLLPLALLLHAARPEVQLVESGGGLVQPGGSLRLSCAASGYTFTSYWMNWVRQ<br>APGKGLVWVSRIDPYDSETHYNQKFKDRFTISVDKAKSTAYLQMNSLRAEDTAVYYCARG |

TABLE 25-continued

Humanized CD123 CAR Constructs

| Name | SEQ ID | Sequence |
|---|---|---|
| | | NWDDYWGQGTTVTVSSGGGGSGGGGSGGGGSGGGGSEVVLTQSPATLSLSPGERATLSCR<br>ASKSISKDLAWYQQKPGQAPRLLIYSGSTLQSGIPARFSGSGSGTDFTLTISSLEPEDFA<br>VYYCQQHNKYPYTFGGGTKVEIK |
| hzCAR123-26 VH | 1271 | EVQLVESGGGLVQPGGSLRLSCAASGYTFTSYWMNWVRQAPGKGLVWVSRIDPYDSETHYNQ<br>KFKDRFTISVDKAKSTAYLQMNSLRAEDTAVYYCARGNWDDYWGQGTTVTVSS |
| hzCAR123-26 VL | 1272 | EVVLTQSPATLSLSPGERATLSCRASKSISKDLAWYQQKPGQAPRLLIYSGSTLQSGIPARF<br>SGSGSGTDFTLTISSLEPEDFAVYYCQQHNKYPYTFGGGTKVEIK |
| hzCAR123-27 NT | 1273 | ATGGCCCTCCCTGTCACCGCCCTGCTGCTTCCGCTGGCTCTTCTGCTCCACGCCGCTCGGCC<br>CGAAGTGCAGCTCGTCGAGAGCGGAGGGGGACTGGTGCAGCCCGGAGGAAGCCTGAGGCTGT<br>CCTGCGCTGCCTCCGGCTACACCTTCACCTCCTACTGGATGAACTGGGTCAGACAGGCACCT<br>GGAAAGGGACTGGTCTGGGTGTCGCGCATTGACCCCTACGACTCCGAAACCCATTACAATCA<br>GAAATTCAAGGACCGCTTCACCATCTCCGTGGACAAAGCCAAGAGCACCGCGTACCTCCAAA<br>TGAACTCCCTGCGCGCTGAGGATACAGCAGTGTACTATTGCGCCCGGGGAAACTGGGATGAT<br>TACTGGGGCCAGGGAACTACTGTGACTGTGTCATCCGGGGGTGGCGGTAGCGGAGGAGGGGG<br>CTCCGGCGGCGGCGGCTCAGGGGGCGGAGGAAGCGACGTCGTGATGACCCAGTCACCGGCAT<br>TCCTGTCCGTGACTCCCGGAGAAAAGGTCACGATTACTTGCCGGGCGTCCAAGAGCATCTCC<br>AAGGACCTCGCCTGGTACCAACAGAAGCCGGACCAGGCCCCTAAGCTGTTGATCTACTCGGG<br>GTCCACCCTTCAATCGGGAGTGCCATCGCGGTTTAGCGGTTCGGGTTCTGGGACCGACTTCA<br>CTTTCACCATCTCCTCACTGGAAGCCGAGGATGCCGCCACTTACTACTGTCAGCAGCACAAC<br>AAGTATCCGTACACCTTCGGAGGCGGTACCAAAGTGGAGATCAAGACCACTACCCCAGCACC<br>GAGGCCACCCACCCCGGCTCCTACCATCGCCTCCCAGCCTCTGTCCCTGCGTCCGGAggcat<br>gtagacccgcagctggtggggccgtgcataccggggtcttgacttcgcctgcgatatctac<br>atttgggcccctctggctggtacttgcggggtcctgctgctttcactcgtgatcactctttta<br>ctgtaagcgcggtcggaagaagctgctgtacatctttaagcaaccttcatgaggcctgtgc<br>agactactcaagaggaggacggctgttcatgccggttcccagaggaggaggaaggcggctgc<br>gaactgcgcgtgaaattcagccgcagcgcagatgctccagcctacaagcaggggcagaacca<br>gctctacaacgaactcaatcttggtcggagagaggagtacgacgtgctggacaagcggagag<br>gacgggacccagaaatgggcgggaagccgcgcagaaagaatcccaagagggcctgtacaac<br>gagctccaaaaggataagatggcagaagcctatagcgagattggtatgaaaggggaacgcag<br>aagaggcaaaggccacgacggactgtaccagggactcagcaccgccaccaaggacacctatg<br>acgctcttcacatgcaggccctgccgcctcgg |
| hzCAR123-27 AA | 1274 | MALPVTALLLPLALLLHAARPEVQLVESGGGLVQPGGSLRLSCAASGYTFTSYWMNWVRQ<br>APGKGLVWVSRIDPYDSETHYNQKFKDRFTISVDKAKSTAYLQMNSLRAEDTAVYYCARG<br>NWDDYWGQGTTVTVSSGGGGSGGGGSGGGGSGGGGSDVVMTQSPAFLSVTPGEKVTITCR<br>ASKSISKDLAWYQQKPDQAPKLLIYSGSTLQSGVPSRFSGSGSGTDFTFTISSLEAEDAA<br>TYYCQQHNKYPYTFGGGTKVEIKTTTPAPRPPTPAPTIASQPLSLRPEACRPAAGGAVHT<br>RGLDFACDIYIWAPLAGTCGVLLLSLVITLYCKRGRKKLLYIFKQPFMRPVQTTQEEDGC<br>SCRFPEEEEGGCELRVKFSRSADAPAYKQGQNQLYNELNLGRREEYDVLDKRRGRDPEMG<br>GKPRRKNPQEGLYNELQKDKMAEAYSEIGMKGERRRGKGHDGLYQGLSTATKDTYDALHM<br>QALPPR |
| hzCAR123-27 scFv | 1275 | MALPVTALLLPLALLLHAARPEVQLVESGGGLVQPGGSLRLSCAASGYTFTSYWMNWVRQ<br>APGKGLVWVSRIDPYDSETHYNQKFKDRFTISVDKAKSTAYLQMNSLRAEDTAVYYCARG<br>NWDDYWGQGTTVTVSSGGGGSGGGGSGGGGSGGGGSDVVMTQSPAFLSVTPGEKVTITCR<br>ASKSISKDLAWYQQKPDQAPKLLIYSGSTLQSGVPSRFSGSGSGTDFTFTISSLEAEDAA<br>TYYCQQHNKYPYTFGGGTKVEIK |
| hzCAR123-27 VH | 1276 | EVQLVESGGGLVQPGGSLRLSCAASGYTFTSYWMNWVRQAPGKGLVWVSRIDPYDSETHYNQ<br>KFKDRFTISVDKAKSTAYLQMNSLRAEDTAVYYCARGNWDDYWGQGTTVTVSS |
| hzCAR123-27 VL | 1277 | DVVMTQSPAFLSVTPGEKVTITCRASKSISKDLAWYQQKPDQAPKLLIYSGSTLQSGVPSRF<br>SGSGSGTDFTFTISSLEAEDAATYYCQQHNKYPYTFGGGTKVEIK |
| hzCAR123-28 NT | 1278 | ATGGCCCTCCCTGTCACCGCCCTGCTGCTTCCGCTGGCTCTTCTGCTCCACGCCGCTCGGCC<br>CGAAGTGCAGCTCGTCGAGAGCGGAGGGGGACTGGTGCAGCCCGGAGGAAGCCTGAGGCTGT<br>CCTGCGCTGCCTCCGGCTACACCTTCACCTCCTACTGGATGAACTGGGTCAGACAGGCACCT<br>GGAAAGGGACTGGTCTGGGTGTCGCGCATTGACCCCTACGACTCCGAAACCCATTACAATCA<br>GAAATTCAAGGACCGCTTCACCATCTCCGTGGACAAAGCCAAGAGCACCGCGTACCTCCAA<br>TGAACTCCCTGCGCGCTGAGGATACAGCAGTGTACTATTGCGCCCGGGGAAACTGGGATGAT<br>TACTGGGGCCAGGGAACTACTGTGACTGTGTCATCCGGGGGTGGCGGTAGCGGAGGAGGGGG<br>CTCCGGCGGCGGCGGCTCAGGGGGCGGAGGAAGCGACGTGGTCATGACTCAGTCCCCGGACT<br>CACTCGCGGTGTCGCTTGGAGAGAGAGCGACCATCAACTGTCGGGCCTCAAAGAGCATCAGC<br>AAGGACCTGGCCTGGTACCAGCAGAAGCCGGGACAGCCGCCAAAGCTGCTGATCTACTCCGG<br>GTCCACCTTGCAATCTGGTGTCCCTGACCGGTTCTCCGGTTCGGGTCGGGTACCGACTTCA<br>CGCTCACTATTTCGTCGCTGCAAGCCGAAGATGTGGCCGTGTACTATTGCCAACAGCACAAC<br>AAGTACCCCTACACTTTTGGCGGAGGCACCAAGGTGGAAATCAAGACCACTACCCCAGCACC<br>GAGGCCACCCACCCCGGCTCCTACCATCGCCTCCCAGCCTCTGTCCCTGCGTCCGGAggcat<br>gtagacccgcagctggtggggccgtgcataccggggtcttgacttcgcctgcgatatctac<br>atttgggcccctctggctggtacttgcggggtcctgctgctttcactcgtgatcactctttta<br>ctgtaagcgcggtcggaagaagctgctgtacatctttaagcaaccttcatgaggcctgtgc<br>agactactcaagaggaggacggctgttcatgccggttcccagaggaggaggaaggcggctgc |

TABLE 25-continued

Humanized CD123 CAR Constructs

| Name | SEQ ID | Sequence |
|---|---|---|
| | | gaactgcgcgtgaaattcagccgcagcgcagatgctccagcctacaagcaggggcagaacca gctctacaacgaactcaatcttggtcggagagaggagtacgacgtgctggacaagcggagag gacgggacccagaaatgggcgggaagccgcgcagaaagaatccccaagagggcctgtacaac gagctccaaaaggataagatggcagaagcctatagcgagattggtatgaaggggaacgcag aagaggcaaaggccacgacggactgtaccagggactcagcaccgccaccaaggacacctatg acgctcttcacatgcaggccctgccgcctcgg |
| hzCAR123-28 AA | 1279 | MALPVTALLLPLALLLHAARPEVQLVESGGGLVQPGGSLRLSCAASGYTFTSYWMNWVRQ APGKGLVWVSRIDPYDSETHYNQKFKDRFTISVDKAKSTAYLQMNSLRAEDTAVYYCARG NWDDYWGQGTTVTVSSGGGGSGGGGSGGGGSGGGGSDVVMTQSPDSLAVSLGERATINCR ASKSISKDLAWYQQKPGQPPKLLIYSGSTLQSGVPDRFSGSGSGTDFTLTISSLQAEDVA VYYCQQHNKYPYTFGGGTKVEIKTTTPAPRPPTPAPTIASQPLSLRPEACRPAAGGAVHT RGLDFACDIYIWAPLAGTCGVLLLSLVITLYCKRGRKKLLYIFKQPFMRPVQTTQEEDGC SCRFPEEEEGGCELRVKFSRSADAPAYKQGQNQLYNELNLGRREEYDVLDKRRGRDPEMG GKPRRKNPQEGLYNELQKDKMAEAYSEIGMKGERRRGKGHDGLYQGLSTATKDTYDALHM QALPPR |
| hzCAR123-28 scFv | 1280 | MALPVTALLLPLALLLHAARPEVQLVESGGGLVQPGGSLRLSCAASGYTFTSYWMNWVRQ APGKGLVWVSRIDPYDSETHYNQKFKDRFTISVDKAKSTAYLQMNSLRAEDTAVYYCARG NWDDYWGQGTTVTVSSGGGGSGGGGSGGGGSGGGGSDVVMTQSPDSLAVSLGERATINCR ASKSISKDLAWYQQKPGQPPKLLIYSGSTLQSGVPDRFSGSGSGTDFTLTISSLQAEDVA VYYCQQHNKYPYTFGGGTKVEIK |
| hzCAR123-28 VH | 1281 | EVQLVESGGGLVQPGGSLRLSCAASGYTFTSYWMNWVRQAPGKGLVWVSRIDPYDSETHYNQ KFKDRFTISVDKAKSTAYLQMNSLRAEDTAVYYCARGNWDDYWGQGTTVTVSS |
| hzCAR123-28 VL | 1282 | DVVMTQSPDSLAVSLGERATINCRASKSISKDLAWYQQKPGQPPKLLIYSGSTLQSGVPDRF SGSGSGTDFTLTISSLQAEDVAVYYCQQHNKYPYTFGGGTKVEIK |
| hzCAR123-29 NT | 1283 | ATGGCCCTCCCTGTCACCGCCCTGCTGCTTCCGCTGGCTCTTCTGCTCCACGCCGCTCGGCC CGACGTGCAGCTCACCCAGTCGCCCTCATTTCTGTCGGCCTCAGTGGGAGACAGAGTGACCA TTACTTGTCGGGCCTCCAAGAGCATCTCCAAGGACCTGGCCTGGTATCAGCAGAAGCCAGGA AAGGCGCCTAAGTTGCTCATCTACTCGGGGTCGACCCTGCAATCTGGCGTGCCGTCCCGGTT CTCCGGTTCGGGAAGCGGTACCGAATTCACCCTTACTATCTCCTCCCTGCAACCGGAGGACT TCGCCACCTACTACTGCCAACAGCACAACAAGTACCCGTACACTTTCGGGGGTGGCACGAAG GTCGAAATCAAGGGGGGTGGCGGTAGCGGAGGAGGGGGCTCCGGCGGCGGCGGCTCAGGGGG CGGAGGAAGCGAAGTGCAGCTCGTCGAGAGCGGAGGGGGACTGGTGCAGCCCGGAGGAAGCC TGAGGCTGTCCTGCGCTGCCTCCGGCTACACCTTCACCTCCTACTGGATGAACTGGGTCAGA CAGGCACCTGGAAAGGGACTGGTCTGGGTGTCGCGCATTGACCCCTACGACTCCGAAACCCA TTACAATCAGAAATTCAAGGACCGCTTCACCATCTCCGTGGACAAAGCCAAGAGCACCGCGT ACCTCCAAATGAACTCCCTGCGCGCTGAGGATACAGCAGTGTACTATTGCGCCCGGGGAAAC TGGGATGATTACTGGGGCCAGGGAACTACTGTGACTGTGTCATCCACCACTACCCCAGCACC GAGGCCACCCACCCCGGCTCCTACCATCGCCTCCCAGCCTCTGTCCCTGCGTCCGGAggcat gtagacccgcagctggtggggccgtgcatacccggggtcttgacttcgcctgcgatatctac atttgggcccctctggctggtacttgcggggtcctgctgcttttcactcgtgatcactcttta ctgtaagcgcggtcggaagaagctgctgtacatctttaagcaaccctttcatgaggcctgtgc agactactcaagaggaggacggctgttcatgccggttcccagaggaggaggaaggcggctgc gaactgcgcgtgaaattcagccgcagcgcagatgctccagcctacaagcaggggcagaacca gctctacaacgaactcaatcttggtcggagagaggagtacgacgtgctggacaagcggagag gacgggacccagaaatgggcgggaagccgcgcagaaagaatccccaagagggcctgtacaac gagctccaaaaggataagatggcagaagcctatagcgagattggtatgaaggggaacgcag aagaggcaaaggccacgacggactgtaccagggactcagcaccgccaccaaggacacctatg acgctcttcacatgcaggccctgccgcctcgg |
| hzCAR123-29 AA | 1284 | MALPVTALLLPLALLLHAARPDVQLTQSPSFLSASVGDRVTITCRASKSISKDLAWYQQK PGKAPKLLIYSGSTLQSGVPSRFSGSGSGTEFTLTISSLQPEDFATYYCQQHNKYPYTFG GGTKVEIKGGGGSGGGGSGGGGSGGGGSEVQLVESGGGLVQPGGSLRLSCAASGYTFTSY WMNWVRQAPGKGLVWVSRIDPYDSETHYNQKFKDRFTISVDKAKSTAYLQMNSLRAEDTA VYYCARGNWDDYWGQGTTVTVSSTTTPAPRPPTPAPTIASQPLSLRPEACRPAAGGAVHT RGLDFACDIYIWAPLAGTCGVLLLSLVITLYCKRGRKKLLYIFKQPFMRPVQTTQEEDGC SCRFPEEEEGGCELRVKFSRSADAPAYKQGQNQLYNELNLGRREEYDVLDKRRGRDPEMG GKPRRKNPQEGLYNELQKDKMAEAYSEIGMKGERRRGKGHDGLYQGLSTATKDTYDALHM QALPPR |
| hzCAR123-29 scFv | 1285 | MALPVTALLLPLALLLHAARPDVQLTQSPSFLSASVGDRVTITCRASKSISKDLAWYQQK PGKAPKLLIYSGSTLQSGVPSRFSGSGSGTEFTLTISSLQPEDFATYYCQQHNKYPYTFG GGTKVEIKGGGGSGGGGSGGGGSGGGGSEVQLVESGGGLVQPGGSLRLSCAASGYTFTSY WMNWVRQAPGKGLVWVSRIDPYDSETHYNQKFKDRFTISVDKAKSTAYLQMNSLRAEDTA VYYCARGNWDDYWGQGTTVTVSS |
| hzCAR123-29 VH | 1286 | EVQLVESGGGLVQPGGSLRLSCAASGYTFTSYWMNWVRQAPGKGLVWVSRIDPYDSETHYNQ KFKDRFTISVDKAKSTAYLQMNSLRAEDTAVYYCARGNWDDYWGQGTTVTVSS |
| hzCAR123-29 VL | 1287 | DVQLTQSPSFLSASVGDRVTITCRASKSISKDLAWYQQKPGKAPKLLIYSGSTLQSGVPSRF SGSGSGTEFTLTISSLQPEDFATYYCQQHNKYPYTFGGGTKVEIK |

TABLE 25-continued

Humanized CD123 CAR Constructs

| Name | SEQ ID | Sequence |
|---|---|---|
| hzCAR123-30 NT | 1288 | ATGGCCCTCCCTGTCACCGCCCTGCTGCTTCCGCTGGCTCTTCTGCTCCACGCCGCTCGGCC<br>CGAAGTGGTGCTGACCCAGTCGCCCGCAACCCTCTCTCTGTCGCCGGGAGAACGCGCCACTC<br>TTTCCTGTCGGGCGTCCAAGAGCATCTCAAAGGACCTCGCCTGGTACCAGCAGAAGCCTGGT<br>CAAGCCCCGCGGCTGCTGATCTACTCCGGCTCCACGCTGCAATCAGGAATCCCAGCCAGATT<br>TTCCGGTTCGGGGTCGGGGACTGACTTCACCTTGACCATTAGCTCGCTGGAACCTGAGGACT<br>TCGCCGTGTATTACTGCCAGCAGCACAACAAGTACCCGTACACCTTCGGAGGCGGTACTAAG<br>GTCGAGATCAAGGGGGGTGGCGGTAGCGGAGGAGGGGGCTCCGGCGGCGGCGGCTCAGGGGG<br>CGGAGGAAGCGAAGTGCAGCTCGTCGAGAGCGGAGGGGGACTGGTGCAGCCCGGAGGAAGCC<br>TGAGGCTGTCCTGCGCTGCCTCCGGCTACACCTTCACCTCCTACTGGATGAACTGGGTCAGA<br>CAGGCACCTGGAAAGGGACTGGTCTGGGTGTCGCGCATTGACCCCTACGACTCCGAAACCCA<br>TTACAATCAGAAATTCAAGGACCGCTTCACCATCTCCGTGGACAAAGCCAAGAGCACCGCGT<br>ACCTCCAAATGAACTCCCTGCGCGCTGAGGATACAGCAGTGTACTATTGCGCCCGGGGAAAC<br>TGGGATGATTACTGGGGCCAGGGAACTACTGTGACTGTGTCATCCACCACTACCCCAGCACC<br>GAGGCCACCCACCCCGGCTCCTACCATCGCCTCCCAGCCTCTGTCCCTGCGTCCGGAggcat<br>gtagacccgcagctggtggggccgtgcataccggggtcttgacttcgcctgcgatatctac<br>atttgggcccctctggctggtacttgcggggtcctgctgctttcactcgtgatcactcttta<br>ctgtaagcgcggtcggaagaagctgctgtacatctttaagcaaccccttcatgaggcctgtgc<br>agactactcaagaggaggacggctgttcatgccggttcccagaggaggaggaaggcggctgc<br>gaactgcgcgtgaaattcagccgcagcgcagatgctccagcctacaagcagggggcagaacca<br>gctctacaacgaactcaatcttggtcggagagaggagtacgacgtgctggacaagcggagag<br>gacgggacccagaaatgggcgggaagccgcgcagaaagaatcccaagagggcctgtacaac<br>gagctccaaaaggataagatggcagaagcctatagcgagattggtatgaaaggggaacgcag<br>aagaggcaaaggccacgacggactgtaccagggactcagcaccgccaccaaggacacctatg<br>acgctcttcacatgcaggccctgccgcctcgg |
| hzCAR123-30 AA | 1289 | MALPVTALLLPLALLLHAARPEVVLTQSPATLSLSPGERATLSCRASKSISKDLAWYQQK<br>PGQAPRLLIYSGSTLQSGIPARFSGSGSGTDFTLTISSLEPEDFAVYYCQQHNKYPYTFG<br>GGTKVEIKGGGGSGGGGSGGGGSGGGGSEVQLVESGGGLVQPGGSLRLSCAASGYTFTSY<br>WMNWVRQAPGKGLVWVSRIDPYDSETHYNQKFKDRFTISVDKAKSTAYLQMNSLRAEDTA<br>VYYCARGNWDDYWGQGTTVTVSSTTTPAPRPPTPAPTIASQPLSLRPEACRPAAGGAVHT<br>RGLDFACDIYIWAPLAGTCGVLLLSLVITLYCKRGRKKLLYIFKQPFMRPVQTTQEEDGC<br>SCRFPEEEEGGCELRVKFSRSADAPAYKQGQNQLYNELNLGRREEYDVLDKRRGRDPEMG<br>GKPRRKNPQEGLYNELQKDKMAEAYSEIGMKGERRRGKGHDGLYQGLSTATKDTYDALHM<br>QALPPR |
| hzCAR123-30 scFv | 1290 | MALPVTALLLPLALLLHAARPEVVLTQSPATLSLSPGERATLSCRASKSISKDLAWYQQK<br>PGQAPRLLIYSGSTLQSGIPARFSGSGSGTDFTLTISSLEPEDFAVYYCQQHNKYPYTFG<br>GGTKVEIKGGGGSGGGGSGGGGSGGGGSEVQLVESGGGLVQPGGSLRLSCAASGYTFTSY<br>WMNWVRQAPGKGLVWVSRIDPYDSETHYNQKFKDRFTISVDKAKSTAYLQMNSLRAEDTA<br>VYYCARGNWDDYWGQGTTVTVSS |
| hzCAR123-30 VH | 1291 | EVQLVESGGGLVQPGGSLRLSCAASGYTFTSYWMNWVRQAPGKGLVWVSRIDPYDSETHYNQ<br>KFKDRFTISVDKAKSTAYLQMNSLRAEDTAVYYCARGNWDDYWGQGTTVTVSS |
| hzCAR123-30 VL | 1292 | EVVLTQSPATLSLSPGERATLSCRASKSISKDLAWYQQKPGQAPRLLIYSGSTLQSGIPARF<br>SGSGSGTDFTLTISSLEPEDFAVYYCQQHNKYPYTFGGGTKVEIK |
| hzCAR123-31 NT | 1293 | ATGGCCCTCCCTGTCACCGCCCTGCTGCTTCCGCTGGCTCTTCTGCTCCACGCCGCTCGGCC<br>CGACGTCGTGATGACCCAGTCACCGGCATTCCTGTCCGTGACTCCCGGAGAAAAGGTCACGA<br>TTACTTGCCGGGCGTCCAAGAGCATCTCCAAGGACCTCGCCTGGTACCAACAGAAGCCGGAC<br>CAGGCCCCTAAGCTGTTGATCTACTCGGGGTCCACCCTTCAATCGGGAGTGCCATCGCGGTT<br>TAGCGGTTCGGGTTCTGGGACCGACTTCACTTTCACCATCTCCTCACTGGAAGCCGAGGATG<br>CCGCCACTTACTACTGTCAGCAGCACAACAAGTATCCGTACACCTTCGGAGGCGGTACCAAA<br>GTGGAGATCAAGGGGGGTGGCGGTAGCGGAGGAGGGGGCTCCGGCGGCGGCGGCTCAGGGGG<br>CGGAGGAAGCGAAGTGCAGCTCGTCGAGAGCGGAGGGGGACTGGTGCAGCCCGGAGGAAGCC<br>TGAGGCTGTCCTGCGCTGCCTCCGGCTACACCTTCACCTCCTACTGGATGAACTGGGTCAGA<br>CAGGCACCTGGAAAGGGACTGGTCTGGGTGTCGCGCATTGACCCCTACGACTCCGAAACCCA<br>TTACAATCAGAAATTCAAGGACCGCTTCACCATCTCCGTGGACAAAGCCAAGAGCACCGCGT<br>ACCTCCAAATGAACTCCCTGCGCGCTGAGGATACAGCAGTGTACTATTGCGCCCGGGGAAAC<br>TGGGATGATTACTGGGGCCAGGGAACTACTGTGACTGTGTCATCCACCACTACCCCAGCACC<br>GAGGCCACCCACCCCGGCTCCTACCATCGCCTCCCAGCCTCTGTCCCTGCGTCCGGAggcat<br>gtagacccgcagctggtggggccgtgcataccggggtcttgacttcgcctgcgatatctac<br>atttgggcccctctggctggtacttgcggggtcctgctgctttcactcgtgatcactcttta<br>ctgtaagcgcggtcggaagaagctgctgtacatctttaagcaaccccttcatgaggcctgtgc<br>agactactcaagaggaggacggctgttcatgccggttcccagaggaggaggaaggcggctgc<br>gaactgcgcgtgaaattcagccgcagcgcagatgctccagcctacaagcagggggcagaacca<br>gctctacaacgaactcaatcttggtcggagagaggagtacgacgtgctggacaagcggagag<br>gacgggacccagaaatgggcgggaagccgcgcagaaagaatcccaagagggcctgtacaac<br>gagctccaaaaggataagatggcagaagcctatagcgagattggtatgaaaggggaacgcag<br>aagaggcaaaggccacgacggactgtaccagggactcagcaccgccaccaaggacacctatg<br>acgctcttcacatgcaggccctgccgcctcgg |
| hzCAR123-31 AA | 1294 | MALPVTALLLPLALLLHAARPDVVMTQSPAFLSVTPGEKVTITCRASKSISKDLAWYQQK<br>PDQAPKLLIYSGSTLQSGVPSRFSGSGSGTDFTFTISSLEAEDAATYYCQQHNKYPYTFG |

TABLE 25-continued

Humanized CD123 CAR Constructs

| Name | SEQ ID | Sequence |
|---|---|---|
| | | GGTKVEIKGGGGSGGGGSGGGGSGGGGSEVQLVESGGGLVQPGGSLRLSCAASGYTFTSY<br>WMNWVRQAPGKGLVWVSRIDPYDSETHYNQKFKDRFTISVDKAKSTAYLQMNSLRAEDTA<br>VYYCARGNWDDYWGQGTTVTVSSTTTPAPRPPTPAPTIASQPLSLRPEACRPAAGGAVHT<br>RGLDFACDIYIWAPLAGTCGVLLLSLVITLYCKRGRKKLLYIFKQPFMRPVQTTQEEDGC<br>SCRFPEEEEGGCELRVKFSRSADAPAYKQGQNQLYNELNLGRREEYDVLDKRRGRDPEMG<br>GKPRRKNPQEGLYNELQKDKMAEAYSEIGMKGERRRGKGHDGLYQGLSTATKDTYDALHM<br>QALPPR |
| hzCAR123-31 scFv | 1295 | MALPVTALLLPLALLLHAARPDVVMTQSPAFLSVTPGEKVTITCRASKSISKDLAWYQQK<br>PDQAPKLLIYSGSTLQSGVPSRFSGSGSGTDFTFTISSLEAEDAATYYCQQHNKYPYTFG<br>GGTKVEIKGGGGSGGGGSGGGGSGGGGSEVQLVESGGGLVQPGGSLRLSCAASGYTFTSY<br>WMNWVRQAPGKGLVWVSRIDPYDSETHYNQKFKDRFTISVDKAKSTAYLQMNSLRAEDTA<br>VYYCARGNWDDYWGQGTTVTVSS |
| hzCAR123-31 VH | 1296 | EVQLVESGGGLVQPGGSLRLSCAASGYTFTSYWMNWVRQAPGKGLVWVSRIDPYDSETHYNQ<br>KFKDRFTISVDKAKSTAYLQMNSLRAEDTAVYYCARGNWDDYWGQGTTVTVSS |
| hzCAR123-31 VL | 1297 | DVVMTQSPAFLSVTPGEKVTITCRASKSISKDLAWYQQKPDQAPKLLIYSGSTLQSGVPSRF<br>SGSGSGTDFTFTISSLEAEDAATYYCQQHNKYPYTFGGGTKVEIK |
| hzCAR123-32 NT | 1298 | ATGGCCCTCCCTGTCACCGCCCTGCTGCTTCCGCTGGCTCTTCTGCTCCACGCCGCTCGGCC<br>CGACGTGGTCATGACTCAGTCCCCGGACTCACTCGCGGTGTCGCTTGGAGAGAGAGCGACCA<br>TCAACTGTCGGGCCTCAAAGAGCATCAGCAAGGACCTGGCCTGGTACCAGCAGAAGCCGGGA<br>CAGCCGCCAAAGCTGCTGATCTACTCCGGGTCCACCTTGCAATCTGGTGTCCCTGACCGGTT<br>CTCCGGTTCCGGGTCGGGTACCGACTTCACGGCTCACTATTTCGTCGCTGCAAGCCGAAGATG<br>TGGCCGTGTACTATTGCCAACAGCACAACAAGTACCCCTACACTTTTGGCGGAGGCACCAAG<br>GTGGAAATCAAGGGGGGTGGCGGTAGCGGAGGAGGGGGCTCCGGCGGCGGCGGCTCAGGGGG<br>CGGAGGAAGCGAAGTGCAGCTCGTCGAGAGCGGAGGGGGACTGGTGCAGCCCGGAGGAAGCC<br>TGAGGCTGTCCTGCGCTGCCTCCGGCTACACCTTCACCTCCTACTGGATGAACTGGGTCAGA<br>CAGGCACCTGGAAAGGGACTGGTCTGGGTGTCGCGCATTGACCCCTACGACTCCGAAACCCA<br>TTACAATCAGAAATTCAAGGACCGCTTCACCATCTCCGTGGACAAAGCCAAGAGCACCGCGT<br>ACCTCCAAATGAACTCCCTGCGCGCTGAGGATACAGCAGTGTACTATTGCGCCCGGGGAAAC<br>TGGGATGATTACTGGGGCCAGGGAACTACTGTGACTGTGTCATCCACCACTACCCCAGCACC<br>GAGGCCACCCACCCCGGCTCCTACCATCGCCTCCCAGCCTCTGTCCCTGCGTCCGGAggcat<br>gtagacccgcagctggtggggccgtgcatacccggggtcttgacttcgcctgcgatatctac<br>atttgggcccctctggctggtacttgcggggtcctgctgctttcactcgtgatcactctta<br>ctgtaagcgcggtcggaagaagctgctgtacatctttaagcaaccctttcatgaggcctgtgc<br>agactactcaagaggaggacggctgttcatgccggttcccagaggaggaggaaggcggctgc<br>gaactgcgcgtgaaattcagccgcagcggacagatgctccagcctacaagcaggggcagaacca<br>gctctacaacgaactcaatcttggtcggagagaggagtacgacgtgctggacaagcggagag<br>gacgggacccagaaatgggcgggaagccgcgcagaaagaatcccaagagggcctgtacaac<br>gagctccaaaaggataagatggcagaagcctatagcgagattggtatgaaaggggaacgcag<br>aagaggcaaaggccacgacggactgtaccagggactcagcaccgccaccaaggacacctatg<br>acgctcttcacatgcaggccctgccgcctcgg |
| hzCAR123-32 AA | 1299 | MALPVTALLLPLALLLHAARPDVVMTQSPDSLAVSLGERATINCRASKSISKDLAWYQQK<br>PGQPPKLLIYSGSTLQSGVPDRFSGSGSGTDFTLTISSLQAEDVAVYYCQQHNKYPYTFG<br>GGTKVEIKGGGGSGGGGSGGGGSGGGGSEVQLVESGGGLVQPGGSLRLSCAASGYTFTSY<br>WMNWVRQAPGKGLVWVSRIDPYDSETHYNQKFKDRFTISVDKAKSTAYLQMNSLRAEDTA<br>VYYCARGNWDDYWGQGTTVTVSSTTTPAPRPPTPAPTIASQPLSLRPEACRPAAGGAVHT<br>RGLDFACDIYIWAPLAGTCGVLLLSLVITLYCKRGRKKLLYIFKQPFMRPVQTTQEEDGC<br>SCRFPEEEEGGCELRVKFSRSADAPAYKQGQNQLYNELNLGRREEYDVLDKRRGRDPEMG<br>GKPRRKNPQEGLYNELQKDKMAEAYSEIGMKGERRRGKGHDGLYQGLSTATKDTYDALHM<br>QALPPR |
| hzCAR123-32 scFv | 1300 | MALPVTALLLPLALLLHAARPDVVMTQSPDSLAVSLGERATINCRASKSISKDLAWYQQK<br>PGQPPKLLIYSGSTLQSGVPDRFSGSGSGTDFTLTISSLQAEDVAVYYCQQHNKYPYTFG<br>GGTKVEIKGGGGSGGGGSGGGGSGGGGSEVQLVESGGGLVQPGGSLRLSCAASGYTFTSY<br>WMNWVRQAPGKGLVWVSRIDPYDSETHYNQKFKDRFTISVDKAKSTAYLQMNSLRAEDTA<br>VYYCARGNWDDYWGQGTTVTVSS |
| hzCAR123-32 VH | 1301 | EVQLVESGGGLVQPGGSLRLSCAASGYTFTSYWMNWVRQAPGKGLVWVSRIDPYDSETHYNQ<br>KFKDRFTISVDKAKSTAYLQMNSLRAEDTAVYYCARGNWDDYWGQGTTVTVSS |
| hzCAR123-32 VL | 1302 | DVVMTQSPDSLAVSLGERATINCRASKSISKDLAWYQQKPGQPPKLLIYSGSTLQSGVPDRF<br>SGSGSGTDFTLTISSLQAEDVAVYYCQQHNKYPYTFGGGTKVEIK |

The sequences of humanized CDR sequences of the scFv domains of hzCD123 CAR 1-32 are shown in Table 26 for the heavy chain variable domains and in Table 27 for the light chain variable domains. "ID" stands for the respective SEQ ID NO for each CDR.

TABLE 26

Heavy Chain Variable Domain CDR

| | HCDR1 | SEQ ID NO: | HCDR2 | SEQ ID NO: | HCDR3 | SEQ ID NO: |
|---|---|---|---|---|---|---|
| hzCAR123 | GYTFTSYWMN | 1102 | RIDPYDSETHYNQKFKD | 1103 | GNWDDY | 1104 |

TABLE 27

Light Chain Variable Domain CDR

| | LCDR1 | SEQ ID NO: | LCDR2 | SEQ ID NO: | LCDR3 | SEQ ID NO: |
|---|---|---|---|---|---|---|
| hzCAR123 | RASKSISKDLA | 1105 | SGSTLQS | 1106 | QQHNKYPYT | 1107 |

In some embodiments, the CAR123 has a HCDR3 having the sequence YCARGNWDDY (SEQ ID NO: 1529).

The CAR scFv fragments were then cloned into lentiviral vectors to create a full length CAR construct in a single coding frame, and using the EF1 alpha promoter for expression.

Bispecific CAR19/CAR22 Constructs and Function Thereof

Figure 13:
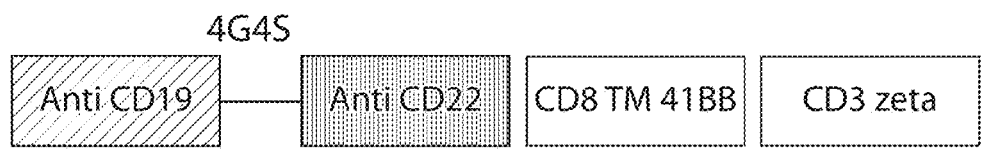
FIG. 13 depicts two constructs for bispecific CARs with anti-C22 and anti-CD19 binding domains. "4G4S" represents the linker sequence GGGGSGGGGSGGGGSGGGGS (SEQ ID NO: 1311).
Figure 13:
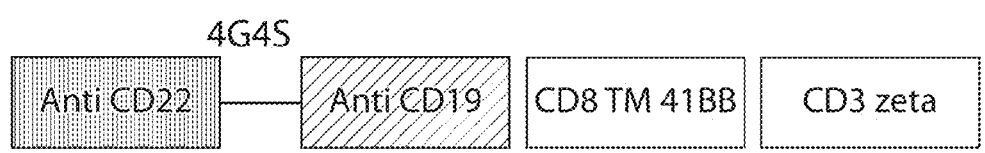

This section describes the production and function of bispecific CAR19/CAR22 constructs. Two bispecific scFv tandem fusions were designed: antiCD22 (HL)4G4S-antiCD19 (LH) and antiCD19-4G4S-antiCD22. The designation (HL) indicates that the heavy chain variable region is upstream of the light chain region within the indicated scFv, and the designation (LH) indicates that the light chain variable region is upstream of the heavy chain region within the indicated scFv. The anti-CD22 base molecule is hCD22-2, and uses the HL orientation. The anti-CD19 base molecule is a humanized anti-CD19 sequence, provided herein as construct ID 104876 of Table 2, which uses the LH orientation. The constructs are illustrated schematically in FIG. 13.

The nucleotide and amino acid sequences of both bispecific constructs, as well as the scFv portions thereof, are given below in Table 28.

TABLE 28

Bispecific CAR19/CAR22 constructs

| Name | SEQ ID NO | Sequence |
|---|---|---|
| antiCD22-4G4S-antiCD19 scFv amino acid sequence | 1303 | EVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARDLGWIAVAGTFDYWGQGTLVTVSSGGGGSGGGGSGGGGSQSALTQPASVSGSPGQSITISCTGTSSDVGGYNYVSWYQQHPGKAPKLMIYDVSKRPSGVSNRFSGSKSGNTASLTISGLQAEDEADYYCSSYTSSSLNHVFGTGTKVTVLTGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSS |
| antiCD22-CD19 CAR amino acid sequence | 1304 | EVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARDLGWIAVAGTFDYWGQGTLVTVSSGGGGSGGGGSGGGGSQSALTQPASVSGSPGQSITISCTGTSSDVGGYNYVSWYQQHPGKAPKLMIYDVSKRPSGVSNRFSGSKSGNTASLTISGLQAEDEADYYCSSYTSSSLNHVFGTGTKVTVLTGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| antiCD22-4G4S-antiCD19 scFv nucleic sequence | 1305 | gaagtgcagctccaacagtcaggaccaggactcgtcaaaccctcccaaaccctcagccttacttgtgccatttccggggattccgtgtcgagcaattcccgcgcctggaactggatcaggcagtccccgtcgcgcgggctcgaatggctgggacgcacttactaccggtccaagtggtacaacgactacgccgtcagcgtgaagtcgcggatcaccattaaccccgacacctccaagaaccagttcagcctccaactgaactccgtgacccctgaggataccgcggtctactattgtgcccgggacctgggttggattgccgtggccgggaccttcgattactggggccagggaactctcgtcaccgtgtcctcggggggggtggctcagggggtggtggatcgggtggtggcggctcccagtccgctctgactcagcccgcgtccgtgtccggttcccgggacagtcgatcacaatcagctgcactggcacctcctccgacgtcggcggtacaactacgtgtcgtggtaccaacagcaccctggaaaagccccgaagctgatgatctacgacgtgtccaagaggccaagcggagtgtcaaatcgcttttccggctcgaagtcgggaaacaccg |

TABLE 28-continued

Bispecific CAR19/CAR22 constructs

| Name | SEQ ID NO | Sequence |
|---|---|---|
| | | ccagcctgactatctcgggactgcaggccgaggacgaggccgactacta<br>ctgctcgtcttacacctcctcatccttgaaccacgtgttcggaaccgga<br>accaaggtcaccgtgctgactggaggggggaggctccggtggcggcggct<br>ctggaggaggagggtccggcggaggaggatcggaaatcgtgatgaccca<br>gtccccgcaaccctgtccctgagcccgggcgaaagagctaccctgtcg<br>tgccgggcgtcgcaggacatctccaagtacctgaactggtaccagcaga<br>agcccggccaggcaccgagactgctgatctaccacactagccgcctgca<br>ttccggtatccccgcacggttcagcggcagcgggagcggaaccgattac<br>acgctcactatttcctcactgcaacccgaggatttcgctgtgtacttct<br>gccaacaaggaaacaccctgccttataccttcggacagggtacaaagct<br>ggagattaaggggaggaggggggctccggcggcggggggcagcggggggcggc<br>ggaagccaggtccagctgcaggaatccggtccgggactcgtgaagccct<br>ccgaaactctctcccttacgtgcaccgtgtcaggggtgtccctgccgga<br>ctacggagtgtcctggattcggcaacctccggggaagggactggagtgg<br>atcggagtgatctggggctccgaaactacctactaccagtcatcattga<br>agtcaagagtgaccatttcgaaggacaacagcaagaaccaggtgtccct<br>taaactgtccagcgtgaccgcggcggatactgccgtctactactgcgcc<br>aagcactattactacggcggaagctatgcgatggactactggggacagg<br>gcaccttggtcactgtgtcctcc |
| antiCD22-<br>CD19 CAR<br>nucleic acid<br>sequence | 1306 | gaagtgcagctccaacagtcaggaccaggactcgtcaaaccctcccaaa<br>ccctcagccttacttgtgccatttccgggggattccgtgtcgagcaattc<br>cgccgcctggaactggatcaggcagtccccgtcgcgcgggctcgaatgg<br>ctgggacgcacttactaccggtccaagtggtacaacgactacgccgtca<br>gcgtgaagtcgcggatcaccattaaccccgacacctccaagaaccagtt<br>cagcctccaactgaactccgtgacccctgaggataccgcggtctactat<br>tgtgcccgggacctggggttggattgccgtggccgggaccttcgattact<br>ggggccagggaactctcgtcaccgtgtcctcggggagggggtggctcagg<br>gggtggtggatcggtggtggcggctcccagtccgctctgactcagccc<br>gcgtccgtgtccggttccccgggacagtcgatcacaatcagctgcactg<br>gcacctcctccgacgtcggcgggtacaactacgtgtcgtggtaccaaca<br>gcacccctggaaaagccccgaagctgatgatctacgacgtgtccaagagg<br>ccaagcggagtgtcaaatcgcttttccggctcgaagtcgggaaacaccg<br>ccagcctgactatctcgggactgcaggccgaggacgaggccgactacta<br>ctgctcgtcttacacctcctcatccttgaaccacgtgttcggaaccgga<br>accaaggtcaccgtgctgactggaggggggaggctccggtggcggcggct<br>ctggaggaggagggtccggcggaggaggatcggaaatcgtgatgaccca<br>gtccccgcaaccctgtccctgagcccgggcgaaagagctaccctgtcg<br>tgccgggcgtcgcaggacatctccaagtacctgaactggtaccagcaga<br>agcccggccaggcaccgagactgctgatctaccacactagccgcctgca<br>ttccggtatccccgcacggttcagcggcagcgggagcggaaccgattac<br>acgctcactatttcctcactgcaacccgaggatttcgctgtgtacttct<br>gccaacaaggaaacaccctgccttataccttcggacagggtacaaagct<br>ggagattaaggggaggaggggggctccggcggcggggggcagcggggggcggc<br>ggaagccaggtccagctgcaggaatccggtccgggactcgtgaagccct<br>ccgaaactctctcccttacgtgcaccgtgtcaggggtgtccctgccgga<br>ctacggagtgtcctggattcggcaacctccggggaagggactggagtgg<br>atcggagtgatctggggctccgaaactacctactaccagtcatcattga<br>agtcaagagtgaccatttcgaaggacaacagcaagaaccaggtgtccct<br>taaactgtccagcgtgaccgcggcggatactgccgtctactactgcgcc<br>aagcactattactacggcggaagctatgcgatggactactggggacagg<br>gcaccttggtcactgtgtcctccaccactaccccagcaccgaggccacc<br>caccccggctcctaccatgcctcccagcctctgtccctgcgtccggag<br>gcatgtagacccgcagctggtgggccgtgcatacccggggtcttgact<br>tcgcctgcgatatctacatttgggcccctctggctggtacttgcggggt<br>cctgctgctttcactcgtgatcactctttactgtaagcgcggtcggaag<br>aagctgctgtacatctttaagcaaccttcatgaggcctgtgcagacta<br>ctcaagaggaggacggctgttcatgccggttcccagaggaggaggaagg<br>cggctgcgaactgcgcgtgaaattcagccgcagcgcagatgctccagcc<br>tacaagcagggcagaaccagctctacaacgaactcaatcttggtcgga<br>gagaggagtacgacgtgctggacaagcggagaggacgggacccagaaat<br>gggcgggaagccgcgcagaaagaatcccaagagggcctgtacaacgag<br>ctccaaaaggataagatggcagaagcctatagcgagattggtatgaaag<br>gggaacgcagaagaggcaaaggccacgacggactgtaccagggactcag<br>caccgccaccaaggacacctatgacgctcttcacatgcaggccctgccg<br>cctcgg |
| antiCD19-<br>4G4S-<br>antiCD22<br>scFv amino<br>acid sequence | 1307 | EIVMTQSPATLSLSPGERATLSCRASQDISKYLNWYQQKPGQAPRLLIY<br>HTSRLHSGIPARFSGSGSGTDYTLTISSLQPEDFAVYFCQQGNTLPYTF<br>GQGTKLEIKGGGGSGGGGSGGGGSQVQLQESGPGLVKPSETLSLTCTVS<br>GVSLPDYGVSWIRQPPGKGLEWIGVIWGSETTYYQSSLKSRVTISKDNS<br>KNQVSLKLSSVTAADTAVYYCAKHYYYGGSYAMDYWGQGTLVTVSSGGG<br>GSGGGGSGGGGSGGGGSEVQLQQSGPGLVKPSQTLSLTCAISGDSVSSN<br>SAAWNWIRQSPSRGLEWLGRTYYRSKWYNDYAVSVKSRITINPDTSKNQ<br>FSLQLNSVTPEDTAVYYCARDLGWIAVAGTFDYWGQGTLVTVSSGGGGS<br>GGGGSGGGGSQSALTQPASVSGSPGQSITISCTGTSSDVGGYNYVSWYQ |

TABLE 28-continued

Bispecific CAR19/CAR22 constructs

| Name | SEQ ID NO | Sequence |
|---|---|---|
| | | QHPGKAPKLMIYDVSKRPSGVSNRFSGSKSGNTASLTISGLQAEDEADY<br>YCSSYTSSSLNHVFGTGTKVTVLT |
| antiCD19-<br>4G4S-<br>antiCD22<br>CAR amino<br>acid sequence | 1308 | EIVMTQSPATLSLSPGERATLSCRASQDISKYLNWYQQKPGQAPRLLIY<br>HTSRLHSGIPARFSGSGSGTDYTLTISSLQPEDFAVYFCQQGNTLPYTF<br>GQGTKLEIKGGGGSGGGGSGGGGSQVQLQESGPGLVKPSETLSLTCTVS<br>GVSLPDYGVSWIRQPPGKGLEWIGVIWGSETTYYQSSLKSRVTISKDNS<br>KNQVSLKLSSVTAADTAVYYCAKHYYYGGSYAMDYWGQGTLVTVSSGGG<br>GSGGGGSGGGGSGGGGSEVQLQQSGPGLVKPSQTLSLTCAISGDSVSSN<br>SAAWNWIRQSPSRGLEWLGRTYYRSKWYNDYAVSVKSRITINPDTSKNQ<br>FSLQLNSVTPEDTAVYYCARDLGWIAVAGTFDYWGQGTLVTVSSGGGGS<br>GGGGSGGGGSQSALTQPASVSGSPGQSITISCTGTSSDVGGYNYVSWYQ<br>QHPGKAPKLMIYDVSKRPSGVSNRFSGSKSGNTASLTISGLQAEDEADY<br>YCSSYTSSSLNHVFGTGTKVTVLTTTTPAPRPPTPAPTIASQPLSLRPE<br>ACRPAAGGAVHTRGLDFACDIYIWAPLAGTCGVLLLSLVITLYCKRGRK<br>KLLYIFKQPFMRPVQTTQEEDGCSCRFPEEEEGGCELRVKFSRSADAPA<br>YKQGQNQLYNELNLGRREEYDVLDKRRGRDPEMGGKPRRKNPQEGLYNE<br>LQKDKMAEAYSEIGMKGERRRGKGHDGLYQGLSTATKDTYDALHMQALP<br>PR |
| antiCD19-<br>4G4S-<br>antiCD22<br>scFv nucleic<br>acid sequence | 1309 | gaaatcgtgatgacccagtcccccgcaaccctgtccctgagcccgggcg<br>aaagagctaccctgtcgtgccgggcgtcgcaggacatctccaagtacct<br>gaactggtaccagcagaagcccgccaggcaccgagactgctgatctac<br>cacactagccgcctgcattccggtatccccgcacggttcagcggcagcg<br>ggagcggaaccgattacacgctcactatttcctcactgcaacccgagga<br>tttcgctgtgtacttctgccaacaaggaaacaccctgccttataccttc<br>ggacagggtacaaagctggagattaagggaggaggggctccggcggcg<br>ggggcagcggggcggcggaagccaggtccagctgcaggaatccggtcc<br>gggactcgtgaagcctccgaaactctcccttacgtgcaccgtgtca<br>gggtgtccctgccggactacggagtgtcctggattcggcaacctccgg<br>ggaagggactggagtggatcggagtgatctggggctccgaaactaccta<br>ctaccagtcatcattgaagtcaagagtgaccatttcgaaggacaacagc<br>aagaaccaggtgtcccttaaactgtccagcgtgaccgcggcggatactg<br>ccgtctactactgcgccaagcactattactacggcggaagctatgcgat<br>ggactactggggacagggcaccttggtcactgtgtcctccggaggggga<br>ggctccggtggcggcggctctggaggaggagggtccggcggaggaggat<br>cggaagtgcagctccaacagtcaggaccaggactcgtcaaaccctccca<br>aaccctcagccttacttgtgccatttccggggattccgtgtcgagcaat<br>tccgccgcctggaactggatcaggcagtcccgtcgcgcgggctcgaat<br>ggctgggacgcacttactaccggtccaagtggtacaacgactacgccgt<br>cagcgtgaagtcgcggatcaccattaaccccgacacctccaagaaccag<br>ttcagcctccaactgaactccgtgaccctgaggataccgcggtctact<br>attgtgcccgggacctgggttggattgccgtggccgggaccttcgatta<br>ctggggccagggaactctcgtcaccgtgtcctcgggaggggtggctca<br>gggggtggtggatcggtggtggcggctccagtccgctctgactcagc<br>ccgcgtccgtgtccggttcccggggacagtcgatcacaatcagctgcac<br>tggcacctcctccgacgtcggcgggtacaactacgtgtcgtggtaccaa<br>cagcaccctggaaaagccccgaagctgatgatctacgacgtgtccaaga<br>ggccaagcggagtgtcaaatcgcttttccggctcgaagtcgggaaacac<br>cgccagcctgactatctcgggactgcaggccgaggacgaggccgactac<br>tactgctcgtcttacacctcctcatccttgaaccacgtgttcggaaccg<br>gaaccaaggtcaccgtgctgact |
| antiCD19-<br>4G4S-<br>antiCD22<br>CAR nucleic<br>acid sequence | 1310 | gaaatcgtgatgacccagtcccccgcaaccctgtccctgagcccgggcg<br>aaagagctaccctgtcgtgccgggcgtcgcaggacatctccaagtacct<br>gaactggtaccagcagaagcccgccaggcaccgagactgctgatctac<br>cacactagccgcctgcattccggtatccccgcacggttcagcggcagcg<br>ggagcggaaccgattacacgctcactatttcctcactgcaacccgagga<br>tttcgctgtgtacttctgccaacaaggaaacaccctgccttataccttc<br>ggacagggtacaaagctggagattaagggaggaggggctccggcggcg<br>ggggcagcggggcggcggaagccaggtccagctgcaggaatccggtcc<br>gggactcgtgaagcctccgaaactctcccttacgtgcaccgtgtca<br>gggtgtccctgccggactacggagtgtcctggattcggcaacctccgg<br>ggaagggactggagtggatcggagtgatctggggctccgaaactaccta<br>ctaccagtcatcattgaagtcaagagtgaccatttcgaaggacaacagc<br>aagaaccaggtgtcccttaaactgtccagcgtgaccgcggcggatactg<br>ccgtctactactgcgccaagcactattactacggcggaagctatgcgat<br>ggactactggggacagggcaccttggtcactgtgtcctccggaggggga<br>ggctccggtggcggcggctctggaggaggagggtccggcggaggaggat<br>cggaagtgcagctccaacagtcaggaccaggactcgtcaaaccctccca<br>aaccctcagccttacttgtgccatttccggggattccgtgtcgagcaat<br>tccgccgcctggaactggatcaggcagtcccgtcgcgcgggctcgaat<br>ggctgggacgcacttactaccggtccaagtggtacaacgactacgccgt<br>cagcgtgaagtcgcggatcaccattaaccccgacacctccaagaaccag<br>ttcagcctccaactgaactccgtgaccctgaggataccgcggtctact<br>attgtgcccgggacctgggttggattgccgtggccgggaccttcgatta |

TABLE 28-continued

Bispecific CAR19/CAR22 constructs

| Name | SEQ ID NO | Sequence |
|---|---|---|
| | | ctggggccagggaactctcgtcaccgtgtcctcgggaggggtggctca
ggggtggtggatcgggtggtggcggctcccagtccgctctgactcagc
ccgcgtccgtgtccggttccccgggacagtcgatcacaatcagctgcac
tggcacctcctccgacgtcggcgggtacaactacgtgtcgtggtaccaa
cagcaccctggaaaagccccgaagctgatgatctacgacgtgtccaaga
ggccaagcggagtgtcaaatcgcttttccggctcgaagtcgggaaacac
cgccagcctgactatctcgggactgcaggccgaggacgaggccgactac
tactgctcgtcttacacctcctcatccttgaaccacgtgttcggaaccg
gaaccaaggtcaccgtgctgactaccactacccagcaccgaggccacc
caccccggctcctaccatcgcctcccagcctctgtccctgcgtccggag
gcatgtagacccgcagctggtggggccgtgcatacccggggtcttgact
tcgcctgcgatatctacatttgggcccctctggctggtacttgcggggt
cctgctgctttcactcgtgatcactcttttactgtaagcgcggtcggaag
aagctgctgtacatctttaagcaaccctttcatgaggcctgtgcagacta
ctcaagaggaggacggctgttcatgccggttcccagaggaggaggaagg
cggctgcgaactgcgcgtgaaattcagccgcagcgcagatgctccagcc
tacaagcaggggcagaaccagctctacaacgaactcaatcttggtcgga
gagaggagtacgacgtgctggacaagcggagaggacgggacccagaaat
gggcgggaagccgcgcagaaagaatcccaagagggcctgtacaacgag
ctccaaaggataagatggcagaagcctatagcgagattggtatgaaag
gggaacgcagaagaggcaaaggccacgacggactgtaccagggactcag
caccgccaccaaggacacctatgacgctcttcacatgcaggccctgccg
cctcgg |

In some embodiments, the antigen binding domain comprises a HC CDR1, a HC CDR2, and a HC CDR3 of any heavy chain binding domain amino acid sequences listed in Table 28. In embodiments, the antigen binding domain further comprises a LC CDR1, a LC CDR2, and a LC CDR3. In embodiments, the antigen binding domain comprises a LC CDR1, a LC CDR2, and a LC CDR3 of any light chain binding domain amino acid sequences listed in Table 28.

In some embodiments, the antigen binding domain comprises one, two or all of LC CDR1, LC CDR2, and LC CDR3 of any light chain binding domain amino acid sequences listed in Table 28, and one, two or all of HC CDR1, HC CDR2, and HC CDR3 of any heavy chain binding domain amino acid sequences listed in Table 28.

In some embodiments, the CDRs are defined according to the Kabat numbering scheme, the Chothia numbering scheme, or a combination thereof.

Figure 14:
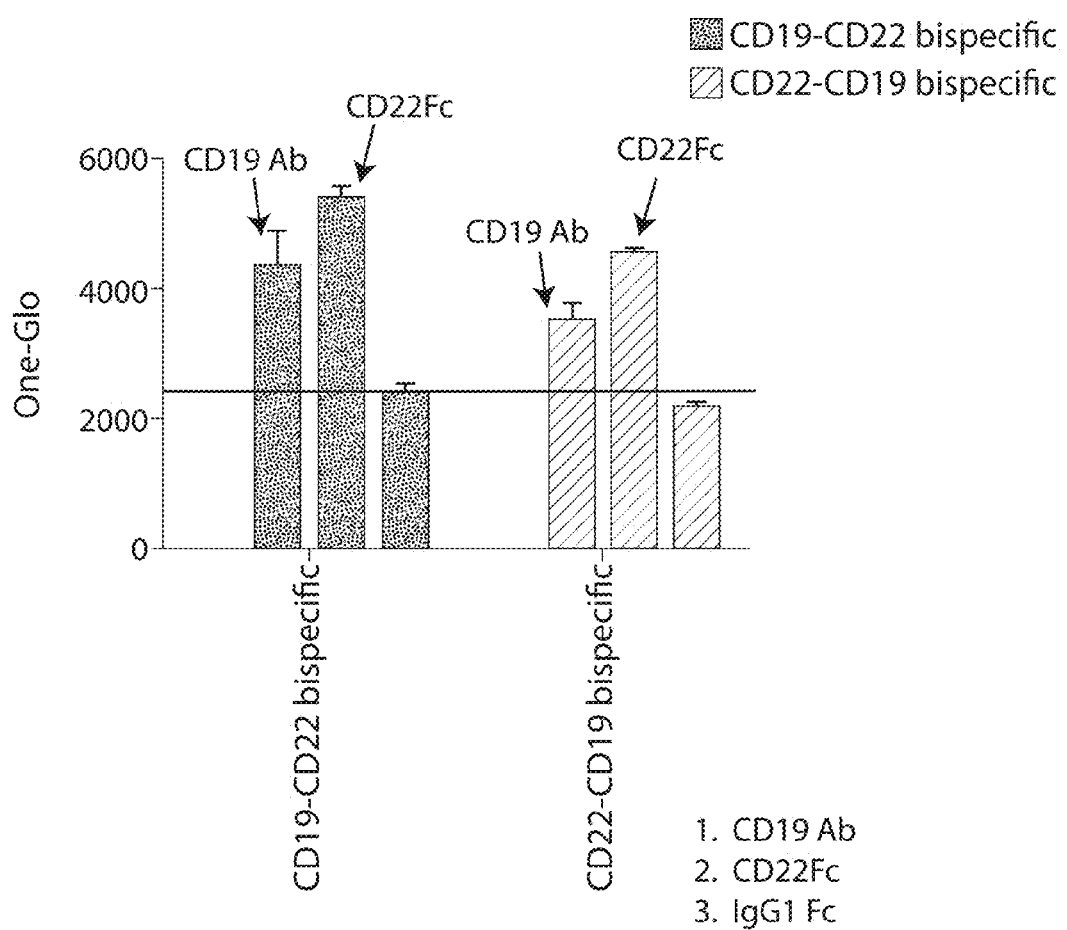
FIG. 14 is a graph depicting the activity of bispecific CD19/CD22 CAR constructs in an NFAT assay.

The bispecific CD19-CD22 and CD22-CD19 constructs described above were tested in an NFAT assay, as described in the Examples below. As controls, an anti-CD19 alone CAR and an anti-CD22 alone CAR were used. The results of this assay are shown in FIG. 14. The data indicated that both anti-CD19 and anti-CD22 scFvs are active against their targets.

EXAMPLES

The invention is further described in detail by reference to the following experimental examples. These examples are provided for purposes of illustration only, and are not intended to be limiting unless otherwise specified. Thus, the invention should in no way be construed as being limited to the following examples, but rather, should be construed to encompass any and all variations which become evident as a result of the teaching provided herein.

Without further description, it is believed that one of ordinary skill in the art can, using the preceding description and the following illustrative examples, make and utilize the compounds of the present invention and practice the claimed methods. The following working examples specifically point out various aspects of the present invention, and are not to be construed as limiting in any way the remainder of the disclosure.

Example 1: CD19 CAR T Cells for Use in Treating Multiple Myeloma

Even with current regimens of chemotherapy, targeted therapies, and autologous stem cell transplant, myeloma is considered an incurable disease. The present example describes treating multiple myeloma (MM) with autologous T cells directed to CD19 with a chimeric antigen receptor (lentivirus/CD19:4-1BB:CD3zeta; also known as "CART19" or CTL019). This example demonstrates that CD19-directed CAR therapies have the potential to establish deep, long-term durable remissions based on targeting the myeloma stem cell and/or tumor cells that express very low (undetectable by most methods) levels of CD19.

In treating a patient with an aggressive secondary plasma cell leukemia, we found that CART19 administered two days after a salvage autologous stem cell transplant resulted in rapid clearance of plasma cell leukemia and a very good partial response in a patient who had progressed through multiple lines of chemotherapy. This patient was transfusion-dependent for months prior to the treatment; at two months after the treatment, she has recovered her blood counts (with normal-range platelet counts and white blood cell counts) and has not required transfusions since she was discharged from the hospital from her treatment.

Because myeloma cells do not naturally express CD19, the finding that CART19 treatment induced a rapid and significant tumor response in this tumor was surprising. Without wishing to be bound by a particular theory, it was reasoned that CART19 could be used to treat myeloma because: (1) while myeloma cells are traditionally thought to be negative for CD19 expression by flow cytometry, there are data indicating that myeloma cells may express very low levels of CD19, such that expression is detectable by RNA but not by flow cytometry or immunohistochemistry; and (2) the concept of targeting the clonotypic B cell, which is thought to be the cancerous stem cell that gives rise to multiple myeloma, and is particularly resistant to chemotherapy. There is a clonal relationship between B cells and myeloma tumor cells, but traditional myeloma therapy is aimed at the malignant plasma cells rather than B cells. CART19 for treating myeloma therefore targets a different cell population than most myeloma therapies.

In our single patient experience, the patient had circulating plasma cells, and we were able to test her tumor cells for the expression of CD19. Approximately 1-2% of her tumor cells expressed the CD19 antigen. Thus, it was reasoned that CART19 may have a direct effect on a very small population of her tumor cells; a very good partial response, though would not have been predicted based on targeting only the very small population of CD19+ tumor cells.

In this case, CART19 was administered following autologous stem cell transplant rescue after high-dose melphalan. Although this is a standard therapy in myeloma, it is not curative. Furthermore, this patient had previously undergone tandem autologous stem cell transplants and relapsed early (<6 months) after transplant. Without wishing to be bound by a particular theory, use of CART19 cells as described in the present example may have a non-overlapping mechanism in the treatment of myeloma when combined with a salvage autologous stem cell transplant.

Ten additional multiple myeloma patients will be treated with CART19 in a Phase I trial, and at least three patients have been treated to date.

Dose Rationale and Risks/Benefits

We have chosen to use flat dosing via the intravenous route of administration for this protocol. The primary objective of this protocol was to test the safety and feasibility of administering CART-19 cells to patients with multiple myeloma. The primary toxicities that were anticipated are (I) cytokine release when the CARs encounter their surrogate CD19 antigen on malignant or normal B cells; (2) depletion of normal B cells, similar to rituximab therapy; (3) steroid-responsive skin and gastrointestinal syndromes resembling graft-versus-host disease as has been seen previously when expanded/costimulated autologous T-cells have been coupled with ASCT for MM. A theoretical concern was whether transformation or uncontrolled proliferation of the CART-19 T cells might occur in response to high levels of CD19. This was less a concern in this application compared to another study of CLL patients, as the burden of clonotypic B-cells in MM is expected to be far lower than the burden of malignant B-cells in the refractory CLL patients treated on that study.

Dose Rationale

With the first 3 patients, we have observed clinical activity at doses ranging from $1.4 \times 10^7$ to $1.1 \times 10^9$ CART-19 cells. This observation demonstrates, at least in the first 3 patients treated, that there is not an obvious dose response relationship. A complete response was observed in patients administered with two log fold difference in dose. Thus, unlike standard drugs that are metabolized, CAR T cells can have a wide dose response range. This is most likely because the CAR T cells are able to proliferate extensively in the patients. We therefore set a dose range of $1-5 \times 10^8$ CART-19 cells for infusion. In this single-patient study offered on a compassionate use basis, the patient was offered up to $5 \times 10^8$ CART19 cells, with no lower dose limit. For the ten patient trial, patients will be offered $1-5 \times 10^7$ CART-19 cells.

General Design

This was single patient-study offered on a compassionate use basis; it was modeled after a Phase I study to determine if the infusion of autologous T cells transduced to express CART-19 is safe. The primary goals of the study were to determine the safety, tolerability and engraftment potential of CART-19 T cells in patients undergoing salvage ASCT after early relapse following first ASCT. The protocol consists of an open label pilot study.

At entry subjects will undergo a bone marrow biopsy and routine laboratory and imaging assessment of their MM. Eligible subjects will undergo steady-state apheresis to obtain large numbers of peripheral blood mononuclear cells (PBMC) for CART-19 manufacturing. The T cells will be purified from the PBMC, transduced with TCζ/4-1BB lentiviral vector, expanded in vitro and then frozen for future administration. The number of patients who have inadequate T cell collections, expansion or manufacturing compared to the number of patients who have T cells successfully manufactured will be recorded; feasibility of product manufacturing is not expected to be problematic in this patient population.

Subjects will generally have had adequate peripheral blood stem cells remaining stored from the mobilization/collection performed in preparation for their first ASCT to conduct two additional ASCT. Those who do not will undergo a second mobilization/collection procedure either before or after their steady-state apheresis with a regimen according to the treating physician's preference. Approximately two weeks after the initial leukapheresis, subjects will be admitted to the hospital and receive high-dose melphalan (day −2) followed by infusion of autologous stem cells two days later (day 0), and all subjects will receive infusion of CART-19 cells twelve to fourteen days later (day +12-14). Up to 10 patients will be enrolled.

All subjects will have blood tests to assess safety, and engraftment and persistence of the CART-19 cells at regular intervals through week 4 of the study. At day +42 and day +100, subjects will undergo bone marrow aspirates/biopsies to assess the bone marrow plasma cell burden and trafficking of CART-19 cells to the bone marrow. A formal response assessment will be made at day 100 according to International Myeloma Working Group (IMWG) criteria136, and TTP will be monitored according to routine clinical practice for patients with multiple myeloma. The main efficacy outcome measured in this study will be a comparison of TTP after a patient's initial ASCT to TTP after the ASCT on this study.

As the primary endpoint of this study is safety and feasibility of infusion of CART-19 cells with ASCT, the study will employ an early stopping rule. Briefly, if less than 2 severe, unexpected adverse events occur among the first five subjects treated, the study will then accrue an additional five subjects towards a target enrollment of 10. We will observe treated subjects for 40 days after CART-19 infusion (i.e., through the first official response assessment at day 42) before enrolling a subsequent subject until five subjects have been enrolled and so observed. For treatment of the second group of five patients, no waiting period will be required between subjects.

Following the 6 months of intensive follow-up, subjects will be evaluated at least quarterly for two years with a medical history, physical examination, and blood tests. Following this evaluation, subjects will enter a roll-over study for annual follow-up by phone and questionnaire for up to additional thirteen years to assess for the diagnosis of long-term health problems, such as development of new malignancy.

Primary Study Endpoints

This pilot trial is designed to test the safety and feasibility of the autologous T cells transduced with the CD19 TCζ/

4-1BB in patients undergoing salvage ASCT for MM following early relapse after first ASCT.

Primary Safety and Feasibility Endpoints Include:

Occurrence of study-related adverse events, defined as NCJ CTC 2: grade 3 signs/symptoms, laboratory toxicities and clinical events that are possibly, likely or definitely related to study treatment at any time from the infusion until week 24. This will include infusional toxicity and any toxicity possibly related to the CART-19 cells including but not limited to:
a. Fevers
b. Rash
c. Neutropenia, thrombocytopenia, anemia, marrow aplasia
d. Hepatic dysfunction
e. Pulmonary infiltrates or other pulmonary toxicity
f. GVHD-like syndromes affecting gastrointestinal tract or skin.

Feasibility to manufacture CART-19 cells from patient apheresis products. The number of manufactured products that do not meet release criteria for vector transduction efficiency, T cell purity, viability, sterility and tumor contamination will be determined.

The depth and duration of response following autologous stem cell transplant with CART19 will be compared to the depth and duration of response that each patient initially achieved following standard autologous stem cell transplant.

Subject Selection and Withdrawal

Inclusion Criteria

Subjects must have undergone a prior ASCT for MM and have progressed within 365 days of stem cell infusion. Subjects who have undergone two prior ASCTs as part of a planned tandem ASCT consolidation regimen are eligible. Progression will be defined according to IMWG criteria for progressive disease or, for patients who attained CR or sCR after initial ASCT, criteria for relapse from CR (Durie et al. Leukemia 2006; 20(9):1467-1473). N.B.: There is no requirement that patients must enroll within 365 days of prior ASCT, and patients may be treated with other agents, including experimental agents, following relapse/progression after prior ASCT before enrollment on this study.

Subjects must have signed written, informed consent.

Subjects must have adequate vital organ function to receive high-dose melphalan as defined by the following criteria, measured within 12 weeks prior to the date of melphalan infusion: a. Serum creatinine ≤2.5 or estimated creatinine clearance ≥30 ml/min and not dialysis-dependent. b. SGOT ≤3× the upper limit of normal and total bilirubin ≤2.0 mg/dl (except for patients in whom hyperbilirubinemia is attributed to Gilbert's syndrome). c. Left ventricular ejection fraction (LVEF)≥45% or, if LVEF is <45%, a formal evaluation by a cardiologist identifying no clinically significant cardiovascular function impairment. LVEF assessment must have been performed within six weeks of enrollment. d. Adequate pulmonary function with FEV1, FVC, TLC, DLCO (after appropriate adjustment for lung volume and hemoglobin concentration)≥40% of predicted values. Pulmonary function testing must have been performed within six weeks of enrollment.

Subjects must have an ECOG performance status of 0-2, unless a higher performance status is due solely to bone pain.

Exclusion Criteria

Subjects Must not:

Have any active and uncontrolled infection.

Have active hepatitis B, hepatitis C, or HIV infection.

Any uncontrolled medical disorder that would preclude participation as outlined.

Treatment Regimen

Therapy for Relapsed/Progressive Multiple Myeloma

Patients may receive, prior to enrollment, therapy for relapsed/progressive multiple myeloma according to the preference of their treating physicians. Therapy may continue upon enrollment.

Patients must stop all therapy for two weeks prior to apheresis and for two weeks prior to high-dose melphalan. If more than two weeks are expected to lapse between apheresis and high-dose melphalan, patients may resume therapy after apheresis at the discretion of their treating physicians.

High-Dose Melphalan (Day −2)

Patients will be admitted to the hospital on day −3 or −2 and will undergo examination by the attending physician and routine laboratory tests, which will include monitoring parameters for tumor lysis syndrome, prior to commencement of the treatment protocol. Blood for MM monitoring laboratory tests (SPEP, quantitative immunoglobulins, and serum free light chain analysis), will be drawn prior to initiation of therapy if such tests had not been drawn within 7 days of admission.

High-dose therapy will consist of melphalan at a dose of 200 mg/m$^2$ administered intravenously over approximately 20 minutes on day −2. The dose of melphalan will be reduced to 140 mg/m$^2$ for patients >70 years of age or for patients of any age whom, at the discretion of the treating physician, may not tolerate a dose of 200 mg/m$^2$. All patients will receive standard anti-emetic prophylaxis, which may include dexamethasone, and standard antibiotic prophylaxis.

Stem-Cell Re-Infusion (Day 0)

Stem cell infusion will take place on day 0, at least 18 hours after the administration of the high-dose melphalan. Stem cells will be infused intravenously over approximately 20-60 minutes following premedication according to standard institutional practice. At least 2×10$^6$ CD34+ progenitors/kg body weight should be infused. In addition, at least 1×10$^6$ CD34+ progenitors/kg body weight should be available as a back-up stem-cell product to be infused in the event of delayed engraftment or late graft failure. G-CSF should be administered SQ beginning on day +5, dosed according to standard institutional practice. Other supportive care measures such as transfusion support will be done in accordance with standard institutional guidelines.

CART19 Cell Infusion (Day +12-14)

A single dose of CART-19 transduced T cells will be given consisting of up to 5×10$^7$ CART-19 cells. The minimal acceptable dose for infusion of cells transduced with the CD19 TCζ4-1BB vector in this single-patient protocol is 1×10$^7$. CART-19 cells will be given as a single dose by rapid i.v. infusion on day +12-14 after stern cell infusion. If patient fails to meet any of the inclusion criteria described herein in the 12-14 day window, the CART-19 infusion may be delayed beyond day +12-14 until the criteria is satisfied.

Maintenance Lenalidomide

Subjects who received and tolerated maintenance lenalidomide after their first ASCT will re-initiate lenalidomide maintenance therapy at approximately day +100, assuming there are no contraindications in the judgment of the treating physician. The starting dose will be 10 mg daily unless prior experience dictates an alternative starting dose for a particular patient. Maintenance therapy will continue until disease progression or intolerance.

Preparation and Administration of Study Drug

The CART-19 T cells are prepared in the CVPF and are not released from the CVPF until FDA approved release criteria for the infused cells (e.g., cell dose, cell purity, sterility, average copy number of vectors/cell, etc.) are met. Upon release, the cells are taken to the bedside for administration.

Cell thawing. The frozen cells will be transported in dry ice to the subject's bedside. The cells will be thawed at the bedside using a water bath maintained at 36° C. to 38° C. The bag will be gently massaged until the cells have just thawed. There should be no frozen clumps left in the container. If the CART-19 cell product appears to have a damaged or the bag to be leaking, or otherwise appears to be compromised, it should not be infused and should be returned to the CVPF as specified below.

Premedication. Side effects following T cell infusions include transient fever, chills, and/or nausea; see Cruz et al. for review (Cytotherapy 2010; 12(6):743-749). It is recommended that the subject be pre-medicated with acetaminophen and diphenhydramine hydrochloride prior to the infusion of CART-19 cells. These medications may be repeated every six hours as needed. A course of non-steroidal anti-inflammatory medication may be prescribed if the patient continues to have fever not relieved by acetaminophen. It is recommended that patients not receive systemic corticosteroids such as hydrocortisone, prednisone, methylprednisolone or dexamethasone at any time, except in the case of a life-threatening emergency, since this may have an adverse effect on T cells.

Febrile reaction. In the unlikely event that the subject develops sepsis or systemic bacteremia following CAR T cell infusion, appropriate cultures and medical management should be initiated. If a contaminated CART-19 T cell product is suspected, the product can be retested for sterility using archived samples that are stored in the CVPF.

Administration. The infusion will take place in an isolated room in Rhoads, using precautions for immunosuppressed patients. The transduced T cells will be administered by rapid intravenous infusion at a flow rate of approximately 10 mL to 20 ml per minute through an 18-gauge latex free Y-type blood set with a 3-way stopcock. The duration of the infusion will be based on the total volume to be infused and the recommended infusion rate. Each infusion bag will have affixed to it a label containing the following: "FOR AUTOLOGOUS USE ONLY." In addition the label will have at least two unique identifiers such as the subject's initials, birth date, and study number. Prior to the infusion, two individuals will independently verify all this information in the presence of the subject and so confirm that the information is correctly matched to the participant.

Emergency medical equipment (i.e., emergency trolley) will be available during the infusion in case the subject has an allergic response, or severe hypotensive crisis, or any other reaction to the infusion. Vital signs (temperature, respiration rate, pulse, and blood pressure) will be taken before and after infusion, then every 15 minutes for at least one hour and until these signs are satisfactory and stable. The subject will be asked not to leave until the physician considers it is safe for him or her to do so.

Packaging

Infusion will be comprised of a single dose of $1-5\times10^7$ CART19-transduced cells, with a minimal acceptable dose of $1\times10^7$ CART-19 cells for infusion. Each bag will contain an aliquot (volume dependent upon dose) of cryomedia containing the following infusible grade reagents (% v/v): 31.25% plasmalyte-A, 31.25% dextrose (5%), 0.45% NaCl, up to 7.5% DMSO, 1% dextran 40, 5% human serum albumin.

Apheresis

A large volume (12-15 liters or 4-6 blood volumes) apheresis procedure is carried out at the apheresis center. PBMC are obtained for CART-19 during this procedure. From a single leukapheresis, the intention is to harvest at least $5\times10^9$ white blood cells to manufacture CART-19 T cells. Baseline blood leukocytes for FDA look-back requirements and for research are also obtained and cryopreserved. The cell product is expected to be ready for release approximately 2-4 weeks later. Flow cytometry lymphocyte subset quantitation, including CD19 and CD20 B cell determination. Baseline assessment is made for human anti-VSV-G and anti-murine antibody (HAMA). If a subject has previously had an adequate apheresis collection banked according to current Good Manufacturing Practices at the Clinical Cell and Vaccine Production Facility these cells may be used as the source of cells for CART-19 manufacturing. Using a banked apheresis product would avert the expense, time, and risk to the subject of undergoing an additional apheresis collection.

Cytoreductive Chemotherapy

The lymphodepleting chemotherapy will be high-dose melphalan as described herein.

CART-19 Infusion

Infusion will begin on day +12-14 after stem-cell reinfusion.

On day +12-14 prior to the first infusion, patients will have a CBC with differential, and assessment of CD3, CD4 and CD8 counts since chemotherapy is given in part to induce lymphopenia.

The first dose will be administered using a single dose. The cells are thawed at the patient's bedside. The thawed cells will be given at as rapid an infusion rate as tolerated such that the duration of the infusion will be approximately 10-15 minutes. In order to facilitate mixing, the cells will be administered simultaneously using a Y-adapter. Subjects will be infused and premedicated as described herein. Subjects' vital signs will be assessed and pulse oximetry done prior to dosing, at the end of the infusion, and every 15 minutes thereafter for 1 hour and until these are stable and satisfactory. A blood sample for determination of a baseline CART-19 level is obtained any time prior to the first infusion and 20 minutes to 4 hours after each infusion (and sent to TCSL).

Patients experiencing toxicities related to high-dose melphalan will have their infusion schedule delayed until these toxicities have resolved. The specific toxicities warranting delay of T cell infusions include: 1) Pulmonary: Requirement for supplemental oxygen to keep saturation greater than 95% or presence of radiographic abnormalities on chest x-ray that are progressive; 2) Cardiac: New cardiac arrhythmia not controlled with medical management 3) Hypotension requiring vasopressor support. 4) Active Infection: Positive blood cultures for bacteria, fungus, or virus within 48-hours of T cell infusion.

Management of Toxicity

Uncontrolled T cell proliferation. Toxicity associated with allogeneic or autologous T cell infusions has been managed with a course of pharmacologic immunosuppression. T body associated toxicity has been reported to respond to systemic corticosteroids. If uncontrolled T cell proliferation occurs (grade 3 or 4 toxicity related to CART-19 cells), subjects may be treated with corticosteroids. Subjects will be treated with pulse methylprednisolone (2 mg/kg i.v. divided q8 hr×2 days), followed by a rapid taper.

In addition, based on the observations of subjects treated on another protocol, there is some concern for macrophage activation syndrome (MAS), though the CD19+ tumor burden is expected to be much lower in patients with myeloma than in patients with CLL. Treatment and timing of treatment of this toxicity will be at the discretion of the patient's physician and the study investigator. Suggested management might include: if the subject has a fever greater than 101° F. that lasts more than 2 consecutive days and there is no evidence of infection (negative blood cultures, CXR or other source), tocilizumab 4 mg/kg can be considered. The addition of corticosteroids and anti-TNF therapy can be considered at the physician's discretion.

B cell depletion. It is possible that B cell depletion and hypogammaglobulinemia will occur. This is common with anti-CD20 directed therapies. In the event of clinically significant hypogammaglobulinemia (i.e. systemic infections), subjects will be given intravenous immunoglobulin (IVIG) by established clinical dosing guidelines to restore normal levels of serum immunoglobulin levels, as has been done with Rituximab.

Primary graft failure. Primary graft failure (i.e., non-engraftment) may be more common after second ASCT compared to first ASCT. Eligibility criteria stipulate that sufficient stem cells must be available for rescue reinfusion at the discretion of the treating physician in the event of primary graft failure.

Results

Three treatment-refractory, advanced multiple myeloma patients have now been treated with CTL019 in this ongoing trial. Results for two of these patients show that both have had substantial anti-tumor effects from the CTL019 therapy based on the primary efficacy assessment at the three-month time-point. The third patient has not yet reached the three-month time point. The results for the two patients are described in more detail below.

The first myeloma patient has completed her +100 day response assessment and she had a very good response to the CART19 therapy. The following tests were performed with the following results:

SPEP/immunofixation: negative urine immunofixation: faint unmeasurable kappa light chain band on her immunofixation (also present at day 38, so not new)

Otherwise, the patient meets the criteria for stringent complete remission including:

serum free light chain ratio: normal bone marrow biopsy: negative

IgA immunophenotyping: IgA is below the limit of detection

Figure 8:
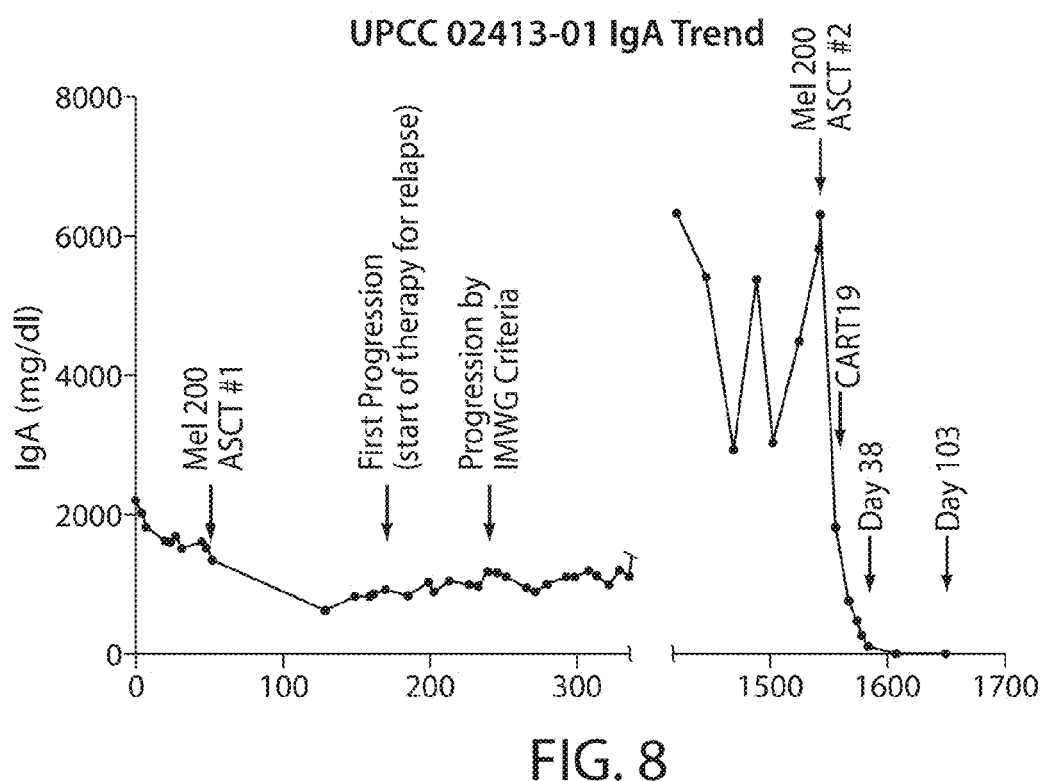
FIG. 8 shows the plasma cell IgA immunophenotyping from a myeloma patient who received CART19, demonstrating the response to CART19 therapy.

Other than the faint unmeasurable kappa light chain result from urine immunofixation, the patient met all criteria for "stringent complete remission". The summary of the plasma cell immunophenotyping at 3 time points (day −2, day +38, day +103) is shown in FIG. 8, and demonstrates that the patient's IgA is below the limit of detection. The summary shows heavy myeloma burden at day −2 and none detectable at day +38 and +103, which classifies the patient as "MRD negative" by flow analysis. At day +103, the summary shows recovery of normal, polyclonal, CD19+ plasma cells and B cells. The patient had no symptoms of disease or therapy and is functioning like a normal person.

The second patient treated has not yet reached the +100 day time point. However, at this time point, she is doing well but it is too early to determine the effect of the CTL019 infusion.

Example 2: CAR19 T Cell Therapy for Hodgkin Lymphoma

Figure 2:
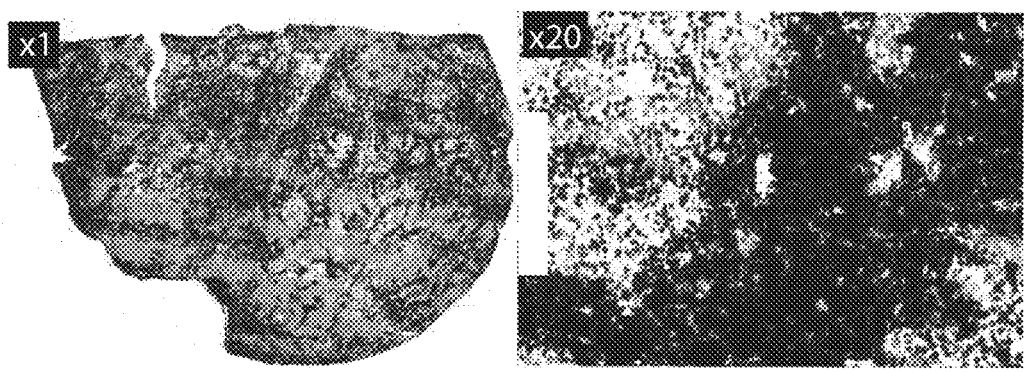
FIG. 2 contains images of immunohistochemical analysis of a Hodgkin lymphoma showing CD19 expressing cells present in the tumor. The left panel is at 1× magnification and the right panel is at 20× magnification.

CAR19 T cell therapy can also be used to treat Hodgkin lymphoma (HL). Hodgkin lymphoma is characterized by the presence of malignant Hodgkin Reed-Sternberg (HRS) cells that are derived from clonal germinal center B cells. There are several factors that indicate the therapeutic efficacy of CAR19 T cell therapy for HL. CD19 staining of HL tumors shows CD19-expressing (CD19$^+$) cells within the tumor and tumor microenvironment (FIG. 2). A study has shown that a clonal B cell population (CD20$^+$CD27$^+$ ALDH$^+$) that expresses CD19 is responsible for the generation and maintenance of Hodgkin lymphoma cell lines, and also circulates in the blood of most HL patients (Jones et al., Blood, 2009, 113(23):5920-5926). This clonal B cell population has also been suggested to give rise to or contribute to the generation of the malignant HRS cells. Thus, CART19 therapy would deplete this B cell population that contributes to tumorigenesis or maintenance of tumor cells. Another study showed that B cell depletion retards solid tumor growth in multiple murine models (Kim et al., J Immunotherapy, 2008, 31(5): 446-57). In support of the idea that depletion of B cells in the HL tumor microenvironment results in some anti-tumor effect, current therapies, such as rituxan, are being clinically tested for targeting and depletion of tumoral B cells in HL (Younes et al., Blood, 2012, 119(18):4123-8). De novo carcinogenesis related to chronic inflammation has also been shown to be B-cell dependent (de Visser, et al., Cancer Cell, 2005, 7(5):411-23). The results from these studies indicate that targeting of the B cell population, particularly in the HL tumor microenvironment, would be useful for treating HL, by reducing or inhibiting disease progression or tumor growth.

In addition, normal CD19-expressing B cells also infiltrate the tumor microenvironment in HL. Previous studies with CART19 therapy in CLL and ALL (e.g., described in Examples 4 and 5) show that CART19 exposure to CD19+ targets leads to cytokine production and macrophage production. Thus, modulation of the HL tumor microenvironment from a pro-tumor microenvironment to an anti-tumor microenvironment can be achieved by infusing CART19 to interact with normal CD19+ B cells present in the HL. For example, CART19 exposure to CD19-expressing targets causes cytokine production, e.g., inflammatory cytokines, that promote anti-tumor activity through the expansion of cytotoxic T cells, activation of macrophages, and recruitment of other immune effector cells with various functions that inhibit tumor growth, such as leukocytes, macrophages, and antigen-presenting cells. Because the target CD19+ B cells may not be malignant (e.g., normally circulating B cells), a transient rather than protracted CART19 effect may be preferred for modulation of the tumor microenvironment.

Figure 3:
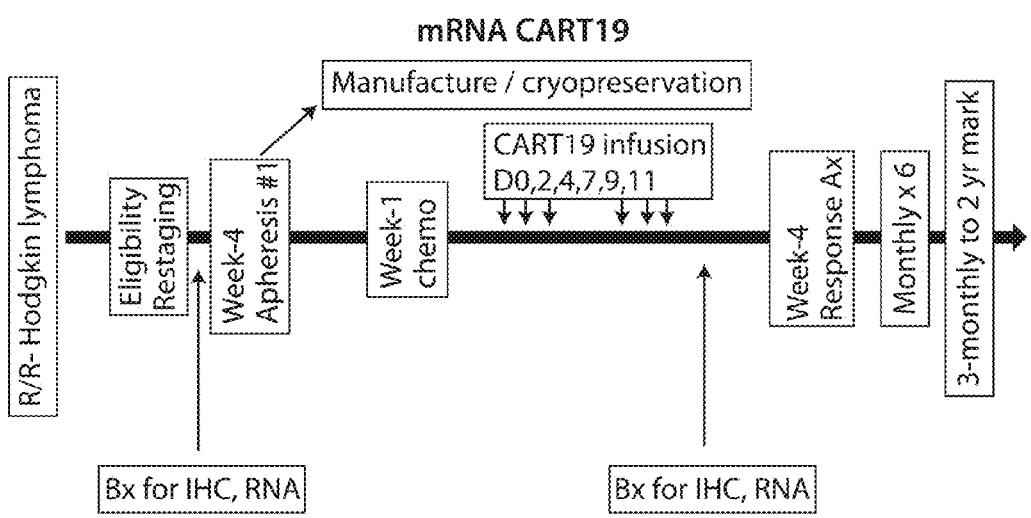
FIG. 3 is a schematic diagram of the experimental set-up for a study to assess the therapeutic efficacy of CART19 treatment in patients with Hodgkin lymphoma.

A study to examine the therapeutic efficacy of CART19 therapy in HL patients can be performed as described below (FIG. 3). The study will also assess the safety and tolerability of CART19 in HL subjects, and determine the effect of CART19 cells on the HL tumor microenvironment.

8 patients with classical HL are treated in this study. Patients are of all ages, though separate protocols for drug delivery can be established for pediatric and adult patients. Patients in this study have no available potentially curative treatment options (such as autologous (ASCT) or allogeneic stem cell transplantation), or are not suitable for such curative treatment options. For example, patients can be any of the following: PET+ after salvage chemotherapy, PET+ after treatment with brentuximab, or PET+ after ASCT with or without prior brentuximab exposure. The patients will have a limited prognosis (several months to less than or equal to 2 year expected survival) with currently available therapies. And finally, the patients will not have received anti-CD20 antibody therapy. Patients are excluded due to lack of feasibility, e.g., if the patient has insufficient numbers of T cells for 6 infusions of CART19.

An mRNA CAR19 is produced by in vitro transcription. The CAR19 mRNA is electroporated into donor T cells, and the resulting cells are expanded and stimulated by incubation with CD3/CD28 beads. Dosages containing $1\times10^8$-$5\times10^8$ RNA-electroporated CAR19 T cells are delivered to the patient three times a week for two weeks (e.g., at day 0, 2, 4, 7, 9 and 11). The overall response rate will be assessed by clinical, CT, and PET scanning at 1 month after treatment. Response and survival will be monitored monthly for the first 6 months, then every 3 months until 2 years after the first CART19 infusion (day 0). Monitoring techniques include biopsy of the tumor or lymph node (e.g., for immunohistochemical analysis and/or RNA for gene expression profiling) and PET scanning before and after CART19 treatment. For example, the effect of the CART19 cells on the HL tumor microenvironment are analyzed by comparing the results of gene expression profiling performed on accessible lymph node biopsies from selected patients before treatment and approximately one week after treatment (or the appropriate time after treatment to allow for alteration of cellular phenotype). To assess the safety and tolerability of CART19 treatment, the frequency and severity of adverse events are reported, including the frequency of cytokine release syndrome (CRS) and macrophage activation syndrome (MAS).

Chemotherapy may be administered concurrently with CART19 treatment. The first dose of CART19 can be preceded by lymphodepleting chemotherapy, e.g., cytoxan.

Example 3: Non-Responder Subset of CLL Patients Exhibit Increased Expression of Immune Checkpoint Inhibitor Molecules In this study, CART19 cells from clinical manufacture from 34 CLL patients were assessed for expression of immune checkpoint inhibitor molecules, such as PD-1, LAGS, and TIM3. The response of this cohort to CART19 was known and hence a correlation between response and biomarker expression patterns could be assessed.

Manufactured CART19 cells from CLL patients with different responses to CART therapy were analyzed by flow cytometry to determine the expression of CAR and the immune checkpoint inhibitor molecules PD-1, LAG3, and TIM3. The CART19 cells were from: healthy donors (HD) (n=2); CLL patients that responded to CART therapy (CR) (n=5); CLL patients that partially responded to CART therapy (PR) (n=8); CLL patients that did not respond to CART therapy (NR) (n=21). Cells were stained with fluorescently labeled antibodies that specifically recognize CD3, CD4, CD8, CD27, CD45RO, the CAR19 molecule, and immune checkpoint molecules PD-1, LAG3, and TIM3, according to standard methods for flow cytometry analysis known in the art. Expression of each marker, e.g., CD4+, CD8+, etc., was determined by flow cytometry analysis software, and subpopulations (e.g., CD4+ T cells, CD8+ T cells, or CAR19-expressing T cells) were further analyzed for the expression of immune checkpoint molecules PD-1, LAG3, and TIM3.

Figures 4A, 4B:
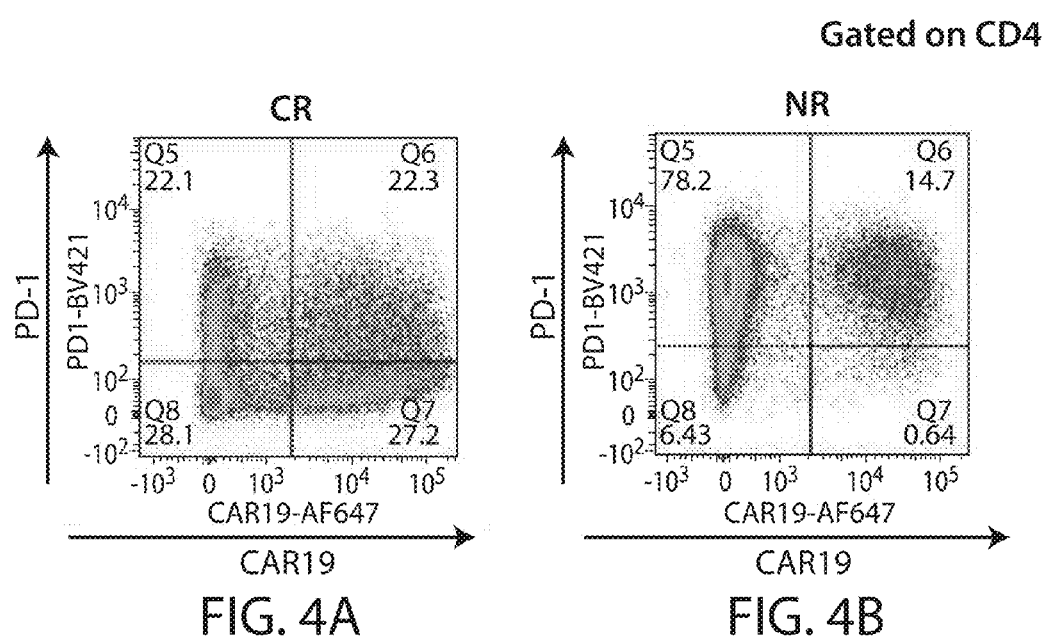
FIGS. 4A, 4B, 4C, and 4D show flow cytometry analysis of PD1 and CAR19 expression on T cells.

An example of the flow cytometry profiles analysis used to determine surface marker expression is shown in FIGS. 4A and 4B. T cells expressing CD4 were determined using flow cytometry, and were further analyzed for CAR19 and PD-1 expression, such that the x-axis of the profiles indicate CAR19 expression (the top left (Q5) and bottom left (Q8) quadrants show the CAR19-negative CD4+ cells, while the top right (Q6) and bottom right (Q7) quadrants show the CAR19-expressing CD4+ cells) and the y-axis shows PD-1 expression (the bottom left (Q8) and right (Q7) quadrants show the PD-1 negative CD4+ cells and the top left (Q5) and right (Q6) quadrants show the PD-1-expressing CD4+ cells). In the CD4+ population from a CART responder, 44.7% of the CD4+ cells overall expressed PD-1, and about 22.3% of the CAR19-expressing cells were PD-1 positive, while 27.2% of CAR19-expressing cells were PD-1 negative (FIG. 4A). In contrast, in the CD4+ population from a non-responder, there was a significant decrease in CAR19-expressing cells overall (about 15.3% compared to the 49.5% in CR), with 14.7% of the CAR19-expressing cells being PD-1 positive while only 0.64% were PD-1 negative (FIG. 4B). Comparison between the profiles in FIG. 4A and FIG. 4B shows that a much higher percentage of the CD4+ cells from a non-responder express PD-1 (about 92.9%) compared to the CART responder (about 44.7%).

Figure 4C:
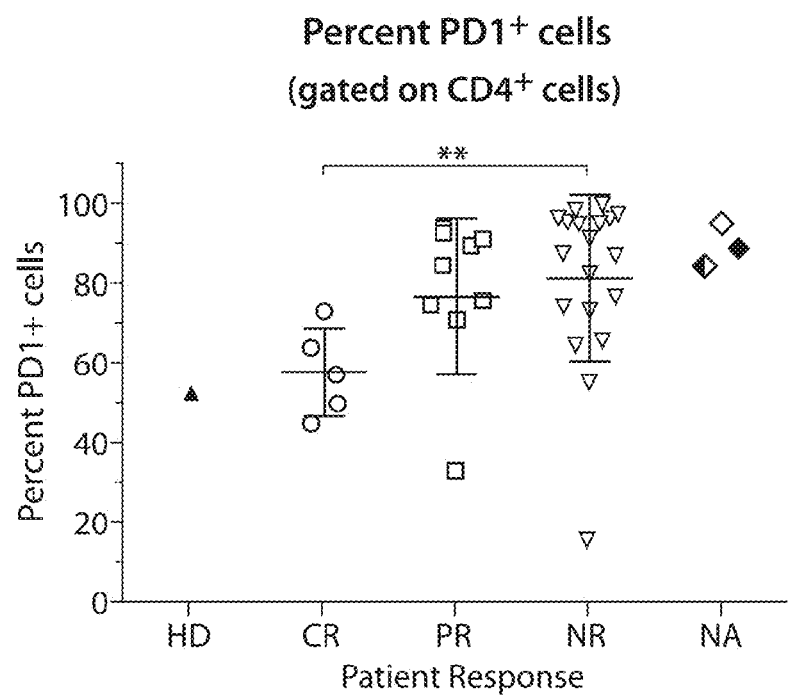
Figure 4D:
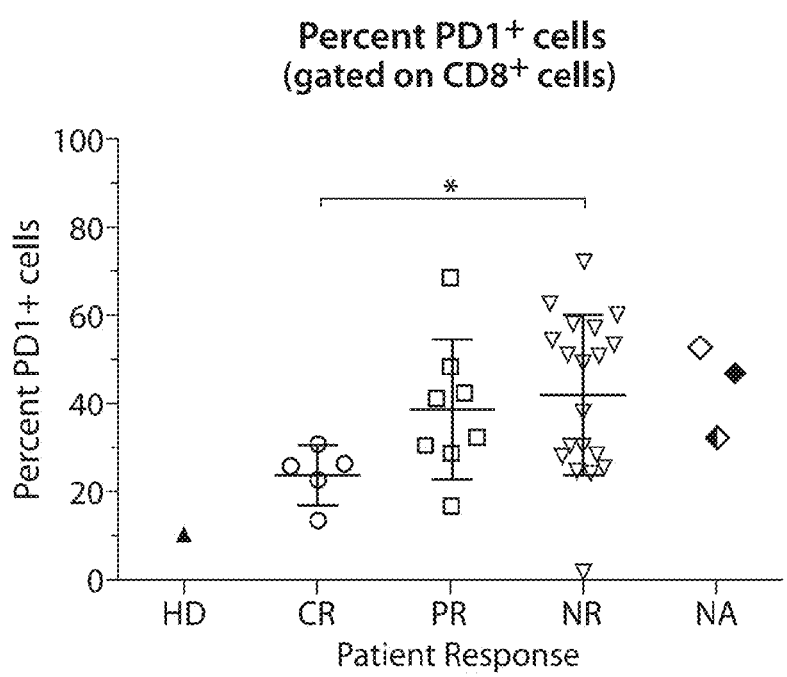

Using the methods and analysis described above, the percentage of PD-1 expressing (PD-1+) cells of the CD4+ population and the CD8+ population was determined for each patient in each response group. Non-responders were shown to have a greater percentage of PD-1+ cells in both the CD4+ (FIG. 4C) and CD8+ (FIG. 4D) populations compared to those that responded to CAR therapy (CR); the increase of average PD-1 percentage was statistically significant for both CD4+ and CD8+ populations. Partial responders (PR) exhibited higher percentages of PD-1+ cells than responders (CR) in both CD4+ (FIG. 4C) and CD8+ (FIG. 4D) populations.

Figure 5A:
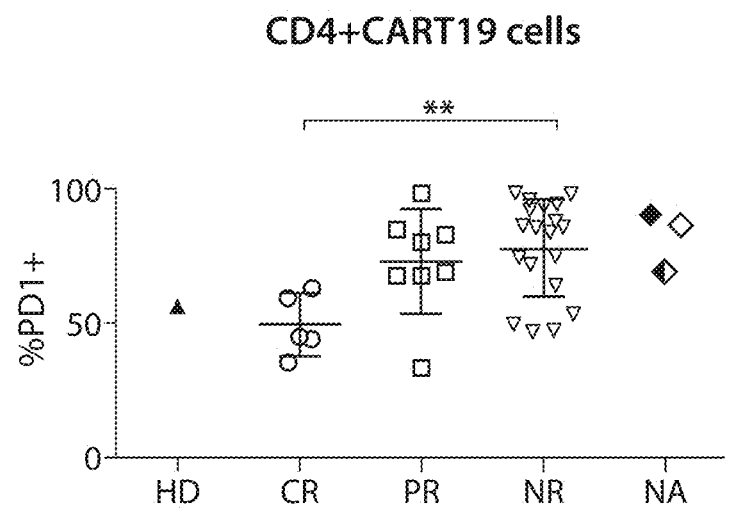
FIGS. 5A and 5B show the distribution of PD1 expression in CD4 and CAR19-expressing cells (FIG. 5A) or CD8 and CAR19-expressing cells (FIG. 5B) from groups of subjects with different responses to CART therapy.
Figure 5B:
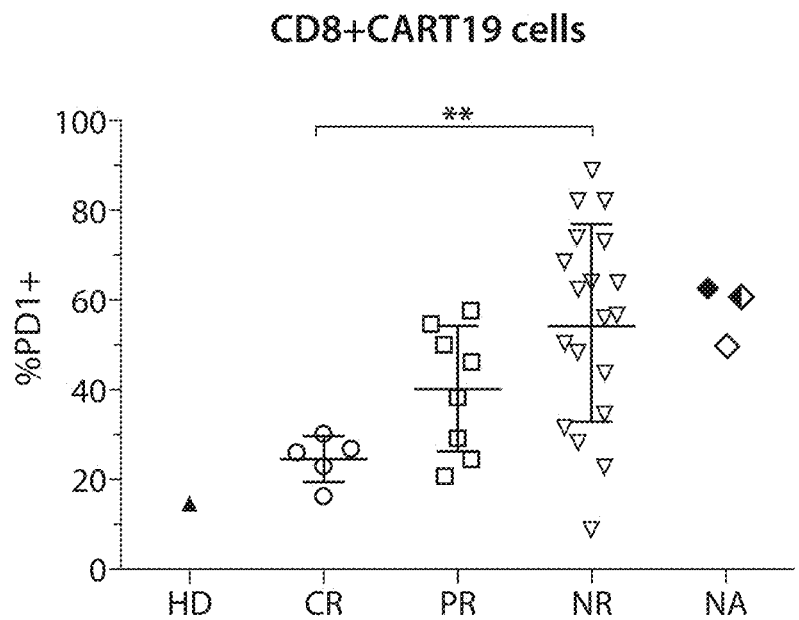

Next, the percentage of PD-1 expressing (PD-1+) cells of the CAR19-expressing CD4+ population and the CAR19-expressing CD8+ population was determined for each patient in each response group. Similar analysis was performed as above, with the additional step of analyzing the CD4+ and CD8+ cells for CAR19-expression, and after identification of the CAR19-expressing cells, determining the percentage of cells with PD-1 expression from the populations of CAR19-expressing cells. A similar trend as that observed in the CD4+ and CD8+ overall populations was observed for the CAR19 expressing CD4+ and CD8+ populations: non-responders were shown to have a greater percentage of PD-1+ cells in both the CD4+ (FIG. 5A) and CD8+ (FIG. 5B) populations compared to those that responded to CAR therapy (CR); the increase of average PD-1 percentage was statistically significant for both CD4+ and CD8+ populations. Partial responders (PR) exhibited higher percentages of PD-1+ cells than responders (CR) in both CD4+ (FIG. 5A) and CD8+ (FIG. 5B) populations.

Figure 6:
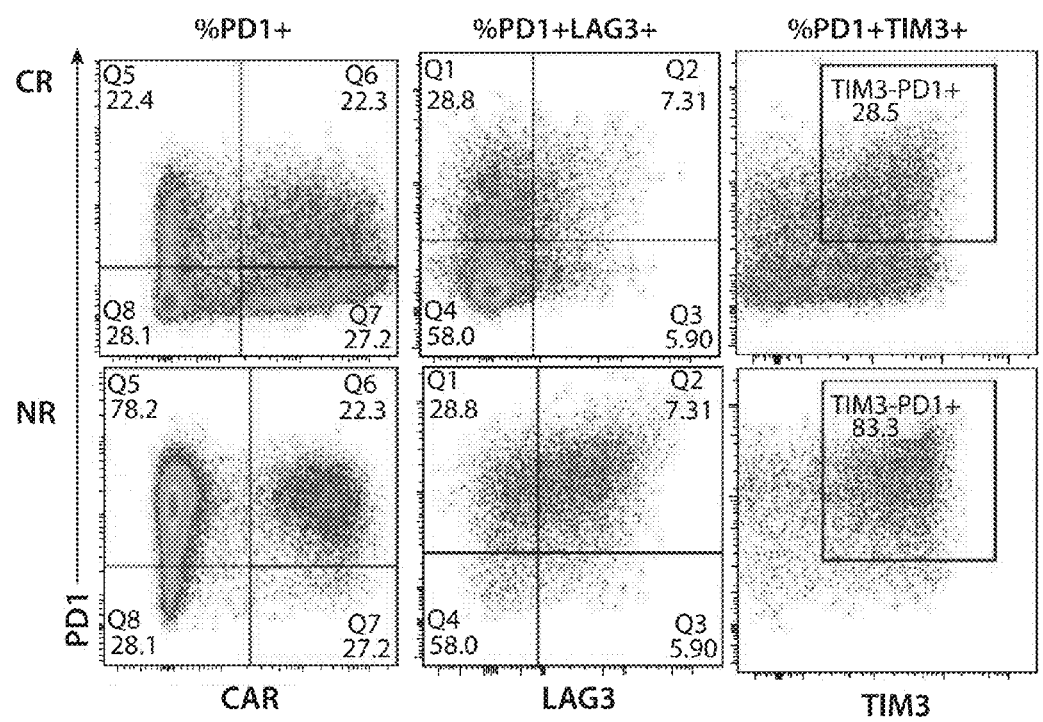
FIG. 6 shows flow cytometry analysis of PD1, CAR 19, LAG5, and TIM3 expression on T cells from subjects that are complete responders (CR) or non-responders (NR) to CART therapy.
Figure 7A:
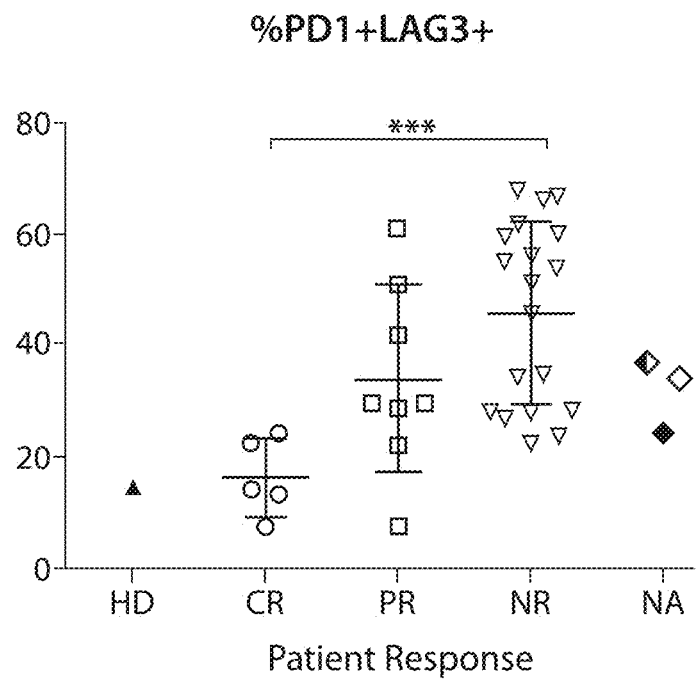
FIGS. 7A and 7B show the distribution of PD1 and LAG3 expression (FIG. 7A) or PD1 and TIM3 expression (FIG. 7B) from groups of subjects with different responses to CART therapy.
Figure 7B:
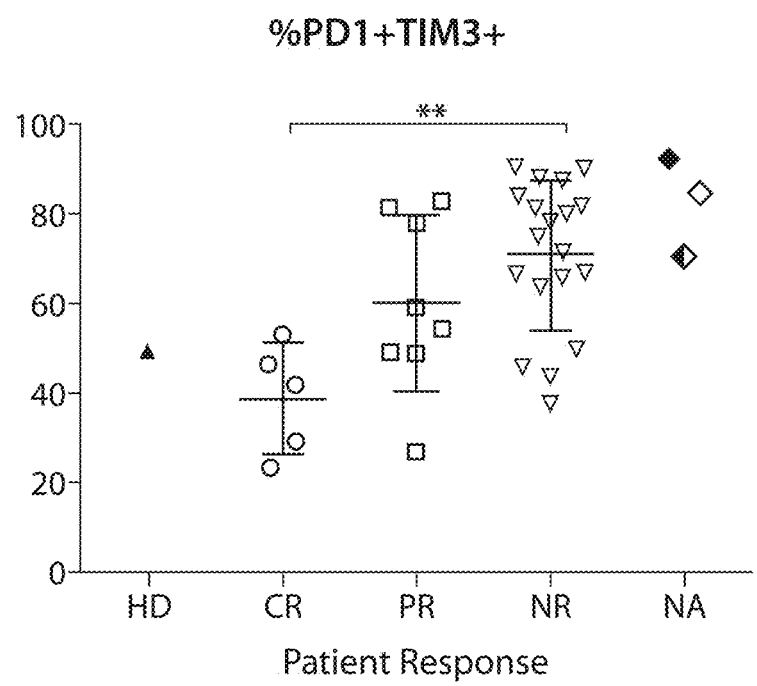

Further analysis was performed to determine the distribution of cells expressing PD-1, LAG3, and TIM3 from patients with different responses to CAR therapy. Representative cell profile analysis for PD-1, LAG3, and TIM3 expression in the CD4+ population is shown in FIG. 6. The cell populations were first analyzed for CD4+ and CD8+ expression. The CD4+ population (or CD8+ population, not shown) was then analyzed for PD-1 and CAR19 expression (FIG. 6, left profiles). As described previously, non-responders (NR) had a significantly increased percentage of cells that were PD-1+ overall compared to CART responders (CR) (about 92.9% PD-1 positive for NR compared to 44.7% PD-1 positive for CR). Moreover, in non-responders, CAR19-expressing cells were mostly PD-1 positive (14.7% PD-1 positive and CAR+ compared to 0.64% PD-1 negative and CAR+). Then the populations were analyzed for PD-1 and LAG3 co-expression (FIG. 6, middle profiles). Cells that expressed both PD-1 and LAG3 are shown in the top right quadrant (Q2). Non-responders had a significantly increased percentage of cells that expressed both immune checkpoint inhibitors, PD-1 and LAG3, compared to CART responders (67.3% compared to 7.31%). PD-1 expression was also analyzed with TIM3 expression. In FIG. 6, right profiles, the box indicates the cells that express both PD-1 and TIM3. Similar to the results obtained with PD-1 and LAG3, the non-responders had a significantly higher percentage of cells that expressed both immune checkpoint inhibitors, PD-1 and TIM3, compared to CART responders (83.3% compared to 28.5%). The percentage of PD-1 expressing cells (PD1+), PD-1 and LAG3-expressing cells (PD1+LAG3+), and PD-1 and TIM3-expressing cells (PD1+TIM3+) was determined for each patient in each response group using the flow cytometry analysis as described above. Non-responders were shown to have an increased percentage of PD1+ LAG3+ cells (FIG. 7A) and PD1+ TIM3+ cells (FIG. 7B) compared to CART responders that was statistically significant for both cell populations. Partial responders also showed an increased percentage of both cell populations compared to CART responders, with the averages being decreased compared to the non-responders.

These results indicate that patients that do not respond to CAR therapy exhibit increased expression of immune checkpoint inhibitors (e.g., PD-1, LAG3, and TIM3) compared to patients that respond or partially respond to CAR therapy. Thus, these results show that agents that inhibit or decrease expression of immune checkpoint inhibitors, e.g., PD-1, LAG3, or TIM3, may be useful for administration to patients receiving CAR therapy to prevent immune suppression through immune checkpoint pathways (e.g., mediated by PD-1, LAG3, or TIM3), thereby increasing the efficacy of the CAR-expressing cells.

Example 4: Effects of mTOR Inhibition on Immunosenescence in the Elderly

The efficacy of mTOR inhibition on immunosenescence is described, e.g., in Example 1 of International Application WO/2015/073644, and the entirety of the application is herein incorporated by reference.

Example 5: Enhancement of Immune Response to Vaccine in Elderly Subjects

The efficacy of mTOR inhibition on enhancing an immune response is described, e.g., in Example 2 of International Application WO/2015/073644, and the entirety of the application is herein incorporated by reference.

Example 6: Low Dose mTOR Inhibition Increases Energy and Exercise

The effect of mTOR inhibition on energy and exercise is described, e.g., in Example 3 of International Application WO/2015/073644, and the entirety of the application is herein incorporated by reference.

Example 7: P70 S6 Kinase Inhibition with RAD001

The effect of mTOR inhibition on P70 S6 kinase inhibition is described, e.g., in Example 4 of International Application WO/2015/073644, and the entirety of the application is herein incorporated by reference.

Example 8: Exogenous IL-7 Enhances the Function of CAR T Cells

After adoptive transfer of CAR T cells, some patients experience limited persistence of the CAR T cells, which can result in suboptimal levels of anti-tumor activity. In this example, the effects of administration of exogenous human IL-7 is assessed in mouse xenograft models where an initial suboptimal response to CAR T cells has been observed.

Figure 9A:
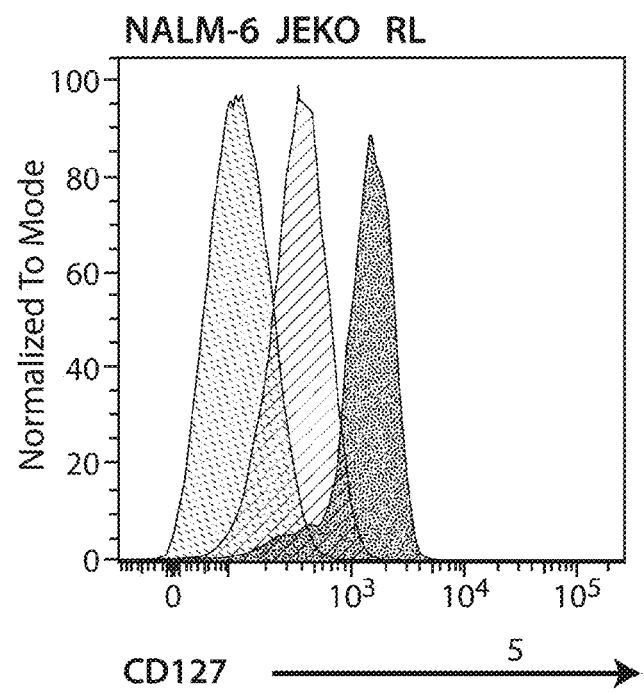
FIGS. 9A and 9B show IL-7 receptor (CD127) expression on cancer cell lines and CART cells. Expression of CD127 was measured by flow cytometry analysis in three cancer cell lines: RL (mantle cell lymphoma), JEKO (also known as Jeko-1, mantle cell lymphoma), and Nalm-6 (B-ALL) (FIG. 9A). CD127 expression was measured by flow cytometry analysis on CD3 positive (CART) cells that had been infused and circulating in NSG mice (FIG. 9B).
Figure 9B:
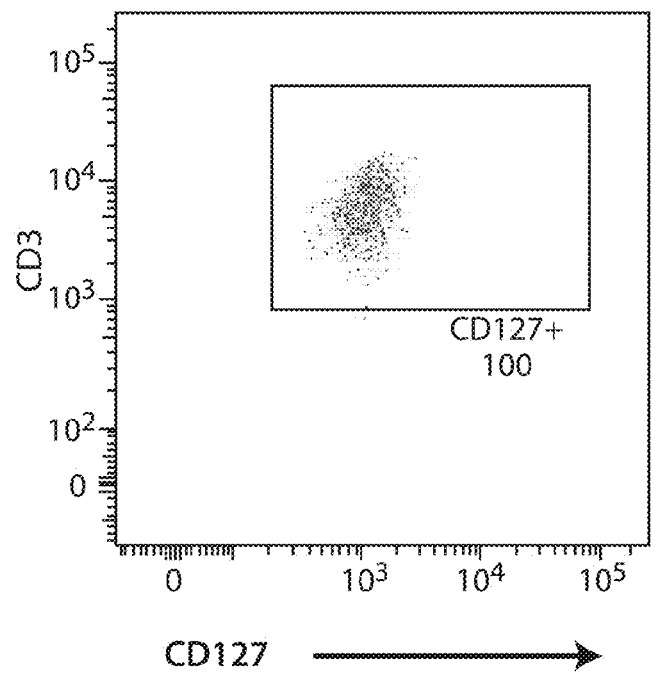

Expression of the IL-7 receptor CD127 was first assessed in different cancer cell lines and in CAR-expressing cells. Two mantle cell lymphoma cell lines (RL and Jeko-1) and one B-ALL cell line (Nalm-6) were analyzed by flow cytometry for CD127 expression. As shown in FIG. 9A, out of the three cancer cell lines tested, RL was shown to have the highest expression of CD127, followed by Jeko-1 and Nalm-6. CART19 cells were infused into NSG mice and CD127 expression was assessed on the circulating CART19 cells by flow cytometry. As shown in FIG. 9B, CD127 is uniformly expressed on all circulating CART19 cells.

Figure 10A:
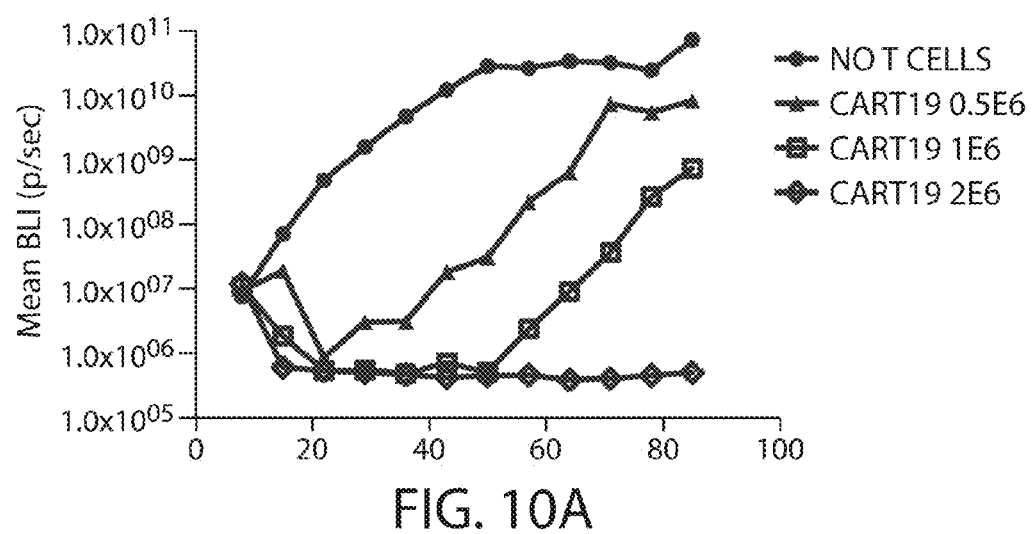
FIGS. 10A, 10B, and 10C show the anti-tumor response after CART19 treatment and subsequent IL-7 treatment. NSG mice engrafted with a luciferase-expressing mantle lymphoma cell line (RL-luc) at Day 0 were treated with varying dosages of CART19 cells at Day 6, and tumor burden was monitored. Mice were divided into 4 groups and received no CART19 cells, 0.5×10$^6$ CART19 cells (CART19 0.5E6), 1×10$^6$ CART19 cells (CART19 1E6), or 2×10$^6$ CART19 cells (CART19 2E6). Tumor burden after CART treatment was measured by detection of bioluminescence (mean BLI) (FIG. 10A). Mice receiving 0.5×10$^6$ CART19 cells (CART19 0.5E6) or 1×10$^6$ CART19 cells (CART19 1E6) were randomized to receive recombinant human IL-7 (rhIL-7) or not. Tumor burden, represented here by mean bioluminescence (BLI), was monitored for the three mice (#3827, #3829, and #3815, receiving the indicated initial CART19 dose) from FIG. 10A that were treated with IL-7 starting at Day 85 (FIG. 10B). IL-7 was administered through IP injection 3 times weekly. Tumor burden, represented here by mean bioluminescence (BLI) before Day 85 (PRE) and after Day 115 (POST) was compared between mice that did not receive IL-7 (CTRL) and mice that received IL-7 treatment (IL-7) (FIG. 10C).
Figure 10B:
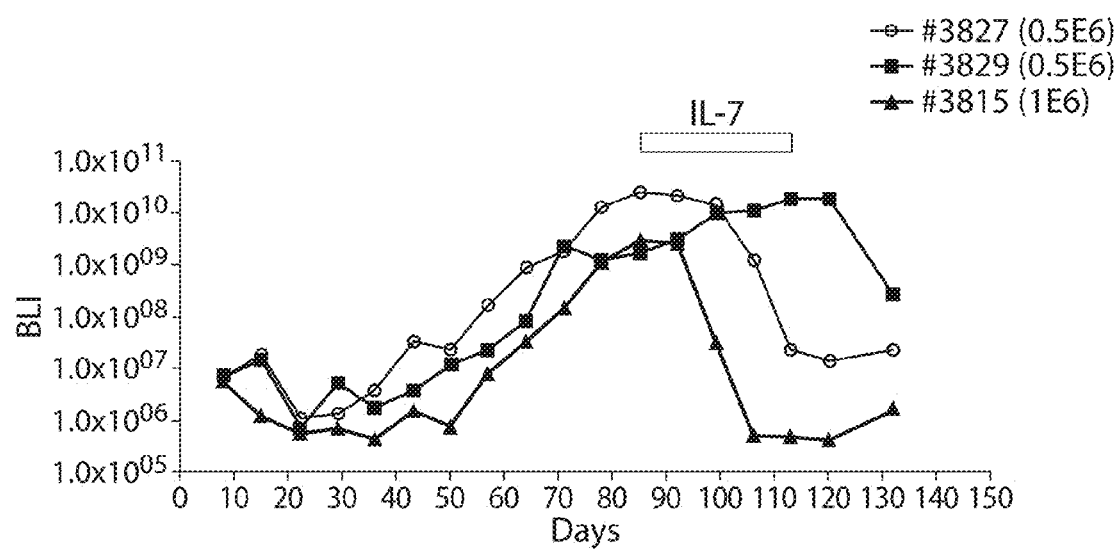
Figure 10C:
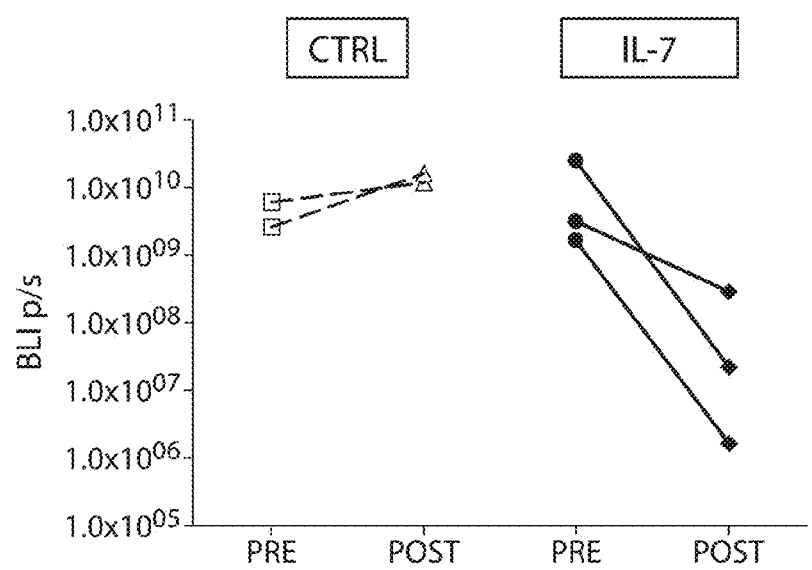

Next, the effect of exogenous IL-7 treatment on anti-tumor activity of CART19 cells was assessed in a lymphoma animal model. NSG mice were engrafted with a luciferase-expressing mantle cell line (RL luc) on Day 0 (D0), followed by treatment of CART19 cells on Day 6. The NSG mice were divided into groups, where one group received no CART19 cells, a second group received $0.5 \times 10^6$ CART19 cells, a third group received $1 \times 10^6$ CART19 cells, and a fourth group received $2 \times 10^6$ CART19 cells. Tumor size was monitored by measuring the mean bioluminescence of the engrafted tumors over more than 80 days. Only mice receiving $2 \times 10^6$ CART19 cells demonstrated rejection of the tumor and inhibition of tumor growth (FIG. 10A). Mice from the two groups receiving $0.5 \times 10^6$ CART19 cells or $1 \times 10^6$ CART19 cells were shown to s a suboptimal anti-tumor response. Mice from these two groups were then randomized, where three mice (mouse #3827 and #3829 which received $0.5 \times 10^6$ CART19 cells, and mouse #3815 which received $1 \times 10^6$ CART19 cells) received exogenous recombinant human IL-7 at a dosage of 200 ng/mouse by intraperitoneal injection three times weekly starting at Day 85, and two mice did not. The tumor burden of mice receiving exogenous IL-7 from Day 85-125, as detected by mean bioluminescence, is shown in FIG. 10B. All mice receiving IL-7 showed a dramatic response of 1-3 log reduction in tumor burden. Mice that originally received a higher dose of CART19 cells (mouse #3815 which received $1 \times 10^6$ CART19 cells) showed a more profound response. When comparing the tumor burden of mice that received IL-7 treatment to control, before and after IL-7 treatment, tumor reduction in tumor burden was only seen in the mice that had received IL-7 treatment (FIG. 10C).

Figure 11A:
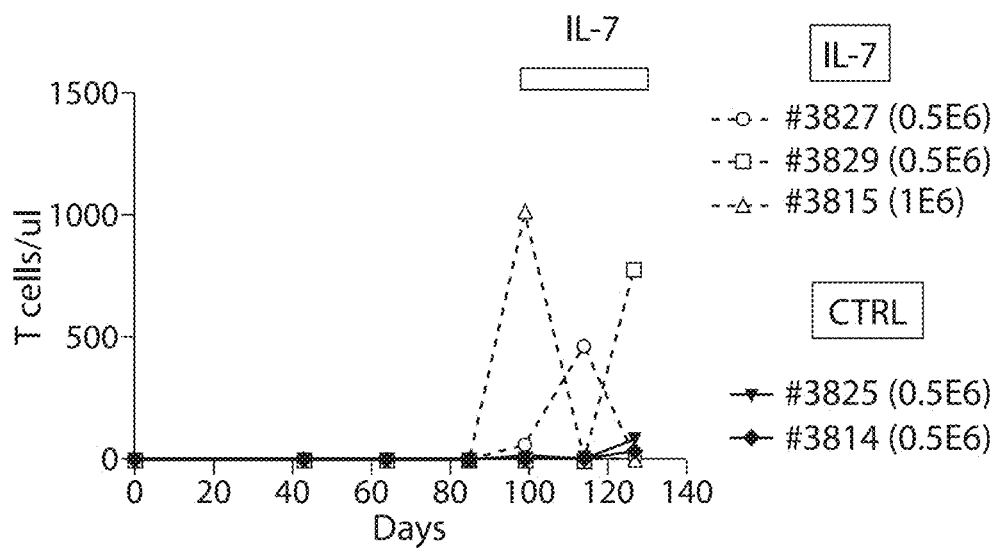
FIGS. 11A and 11B show the T cell dynamics after IL-7 treatment. The level of human T cells detected in the blood was monitored for each of the mice receiving IL-7 or control mice (FIG. 11A). The level of CART19 cells (CD3+ cells) detected in the blood was measured before (PRE) and 14 days after (Day 14) initiation of IL-7 treatment (FIG. 11B).
Figure 11B:
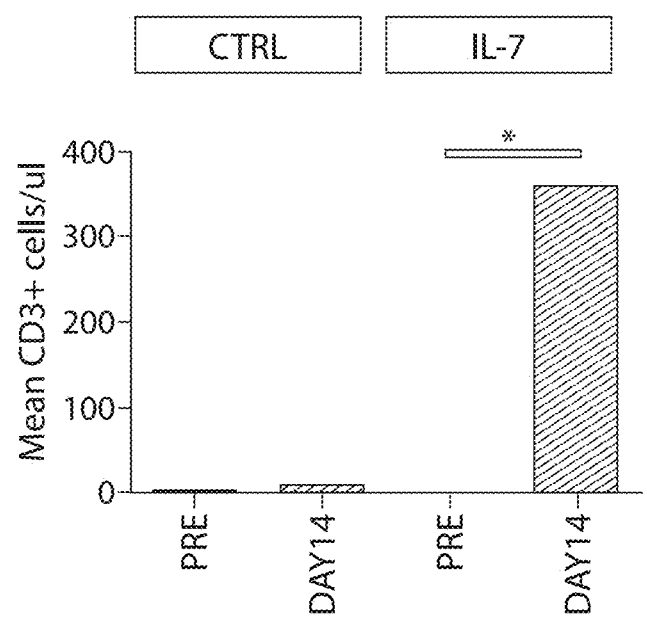
Figure 12:
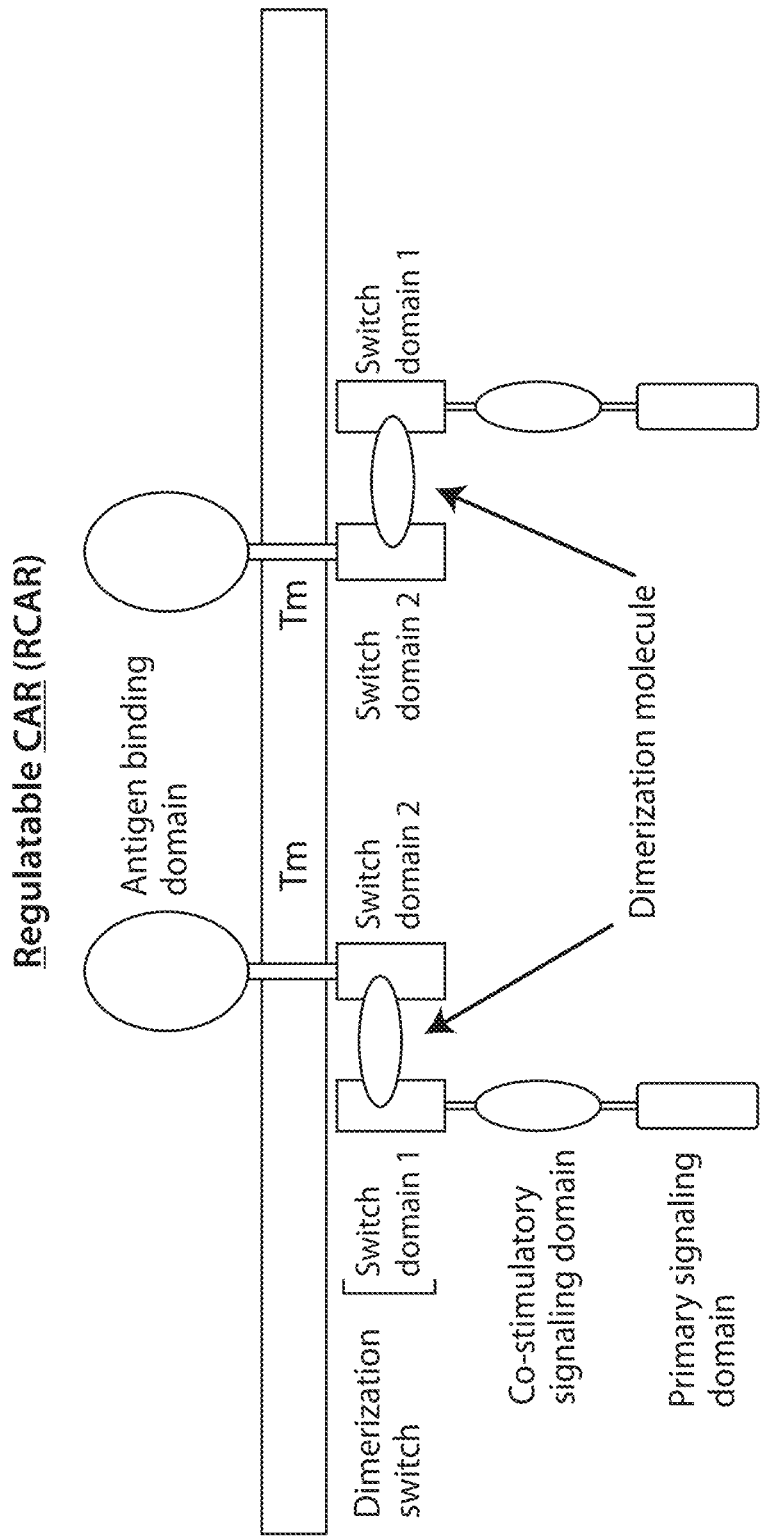
FIG. 12 depicts the structures of two exemplary RCAR configurations. The antigen binding members comprise an antigen binding domain, a transmembrane domain, and a switch domain. The intracellular binding members comprise a switch domain, a co-stimulatory signaling domain and a primary signaling domain. The two configurations demonstrate that the first and second switch domains described herein can be in different orientations with respect to the antigen binding member and the intracellular binding member. Other RCAR configurations are further described herein.

T cell dynamics following IL-7 treatment in the lymphoma animal model was also examined. Human CART19 cells were not detectable in the blood prior to IL-7 treatment. Upon treatment of IL-7, there was rapid, but variable increase in the numbers of T cells in the treated mice (FIG. 11A). The extent of T cell expansion observed in mice receiving the IL-7 also correlated with tumor response. The mouse with the highest number of T cells detected in the blood at peak expansion during IL-7 treatment (mouse #3815) had the most robust reduction in tumor burden (see FIG. 10B). Moreover, the time of peak expansion correlated with the T cell dose injected as baseline. The number/level CD3-expressing cells in the blood were also measured before and after IL-7 treatment. In control mice, very few CD3-expressing cells were detected, while IL-7-treated mice showed a significant increase in CD3+ cells after IL-7 treatment (FIG. 11B).

Together, the results in this example demonstrate that exogenous IL-7 treatment increases T cell proliferation and anti-tumor activity in vivo, indicating that use of IL-7 in patients with suboptimal results after CAR therapy can improve anti-tumor response in these patients.

Example 9: Evaluation of CD22 CAR

Automated Jurkat-NFAT-Luciferase (JNL) Cell Assay

Figure 18A:
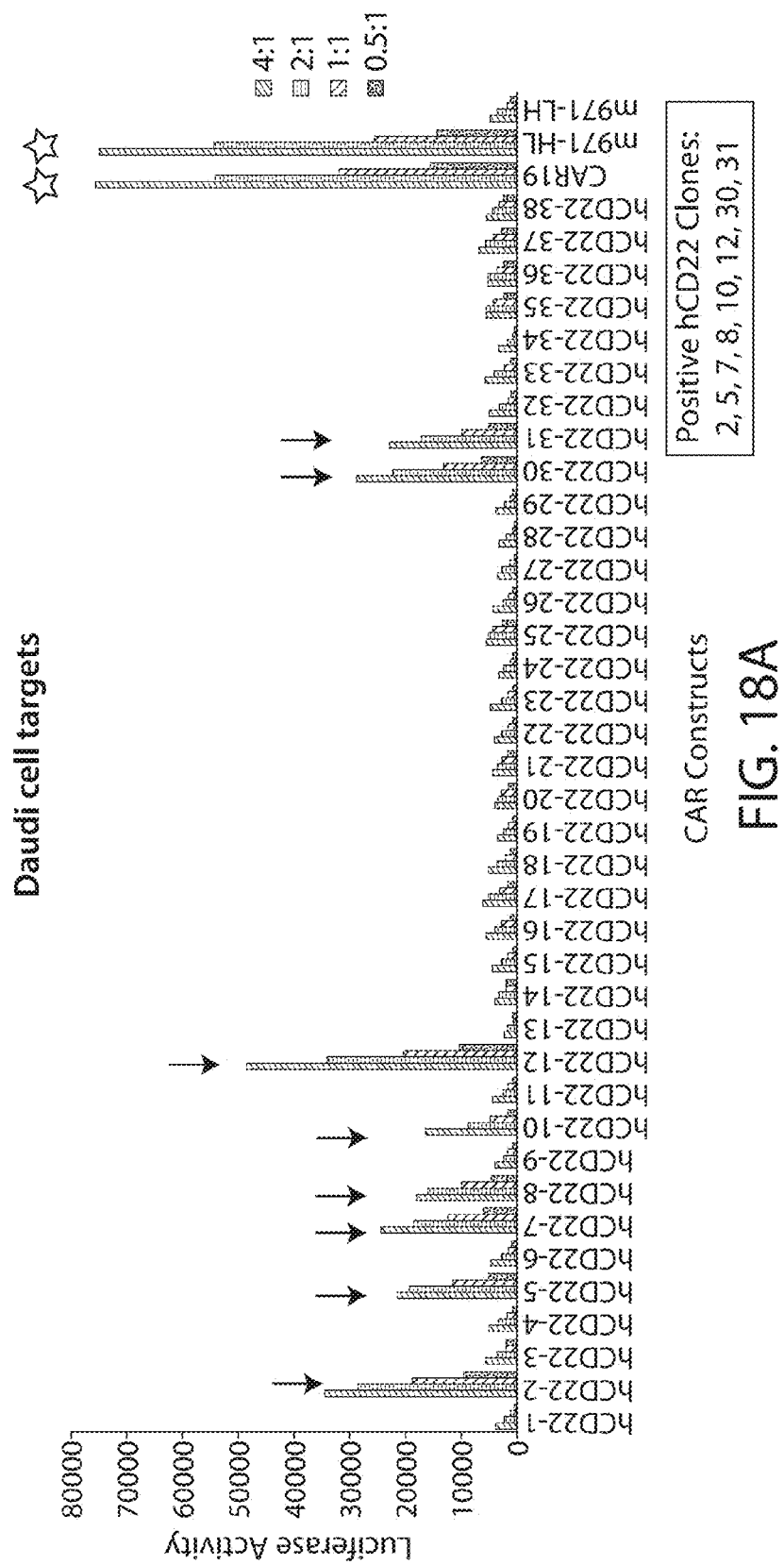
FIGS. 18A, 18B, and 18C are graphs showing CAR T-cell activation in the presence of tumor target cell lines.
Figure 18B:
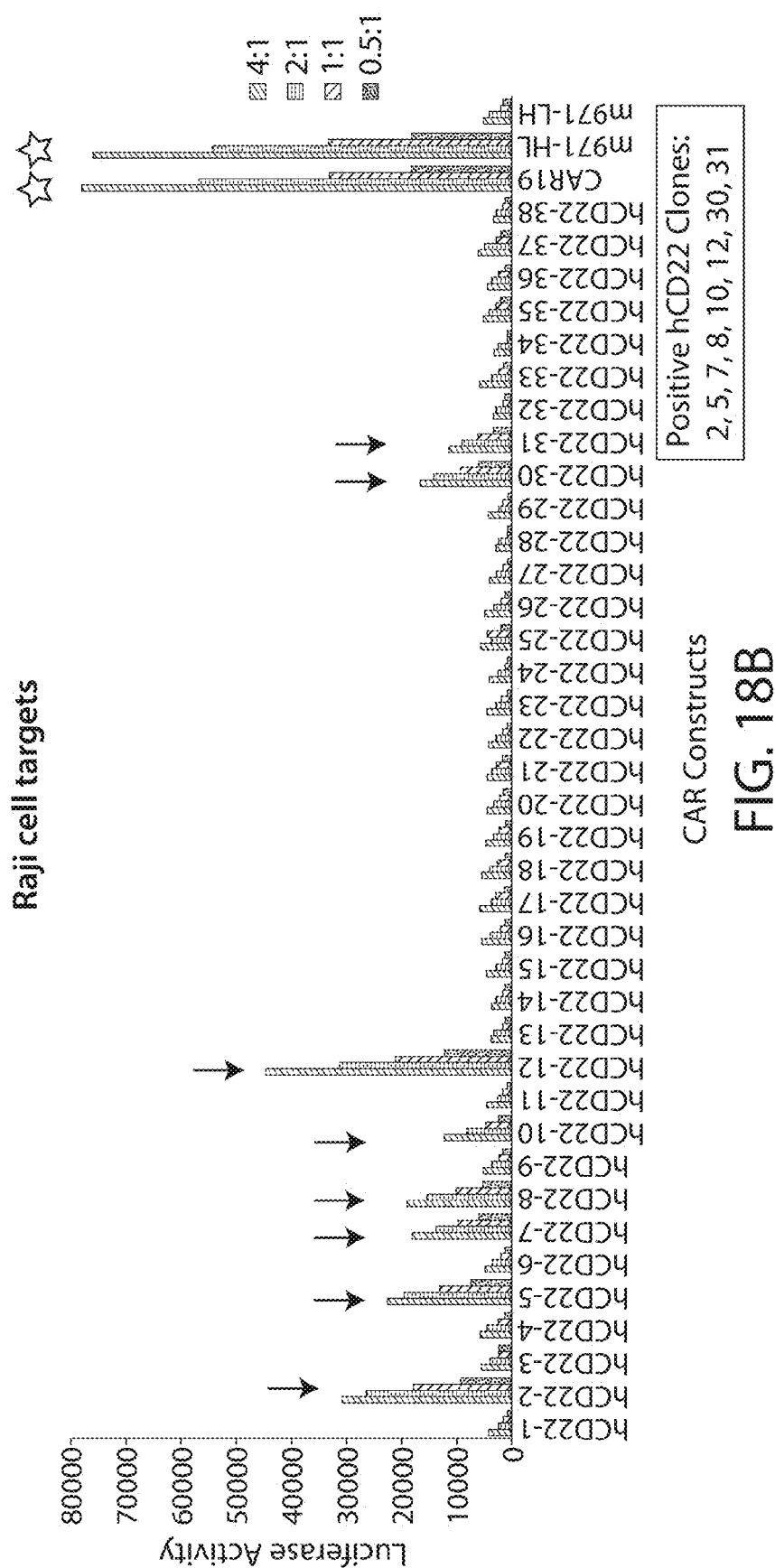
Figure 18C:
Figure 19A:
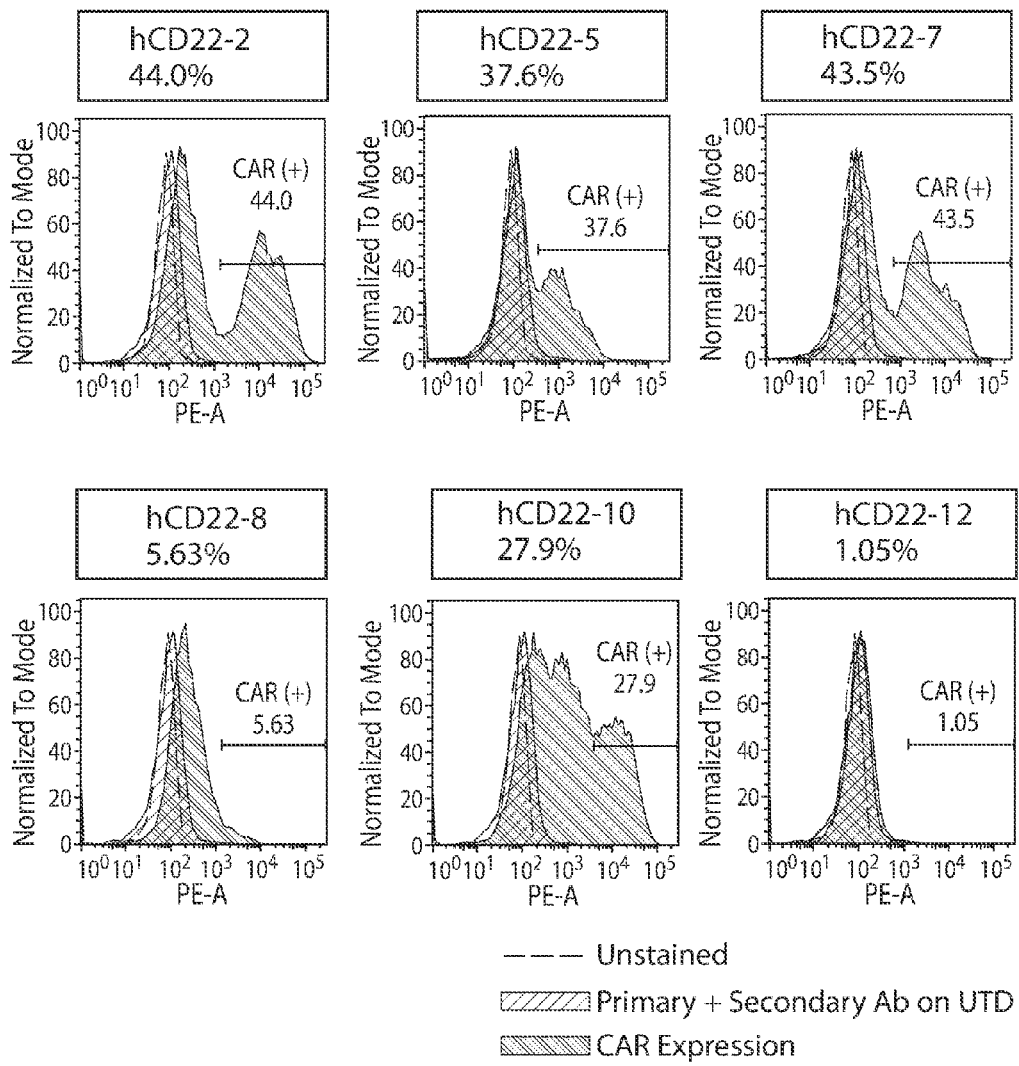
FIGS. 19A, 19B, 19C, and 19D are a graph showing primary T-cells expression of chimeric antigen receptor on the cell surface. Protein-L-biotin/SA-PE (FIG. 19A and FIG. 19B) and rhCD22-Fc/anti-Fc488 (FIGS. 19C and 19D) were used to determine CAR surface expression levels. Cells with no CAR were used as a negative control.
Figure 19B:
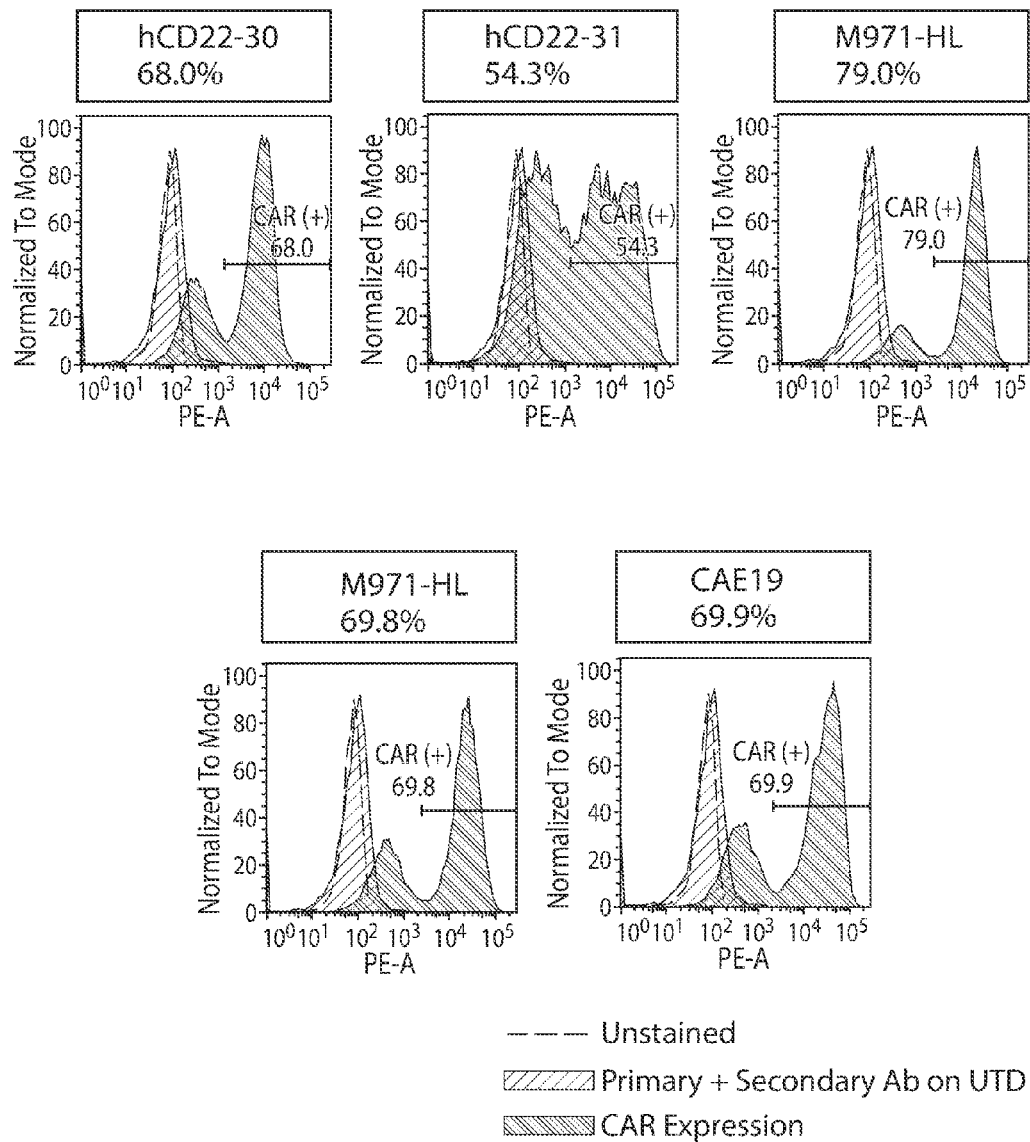
Figure 19C:
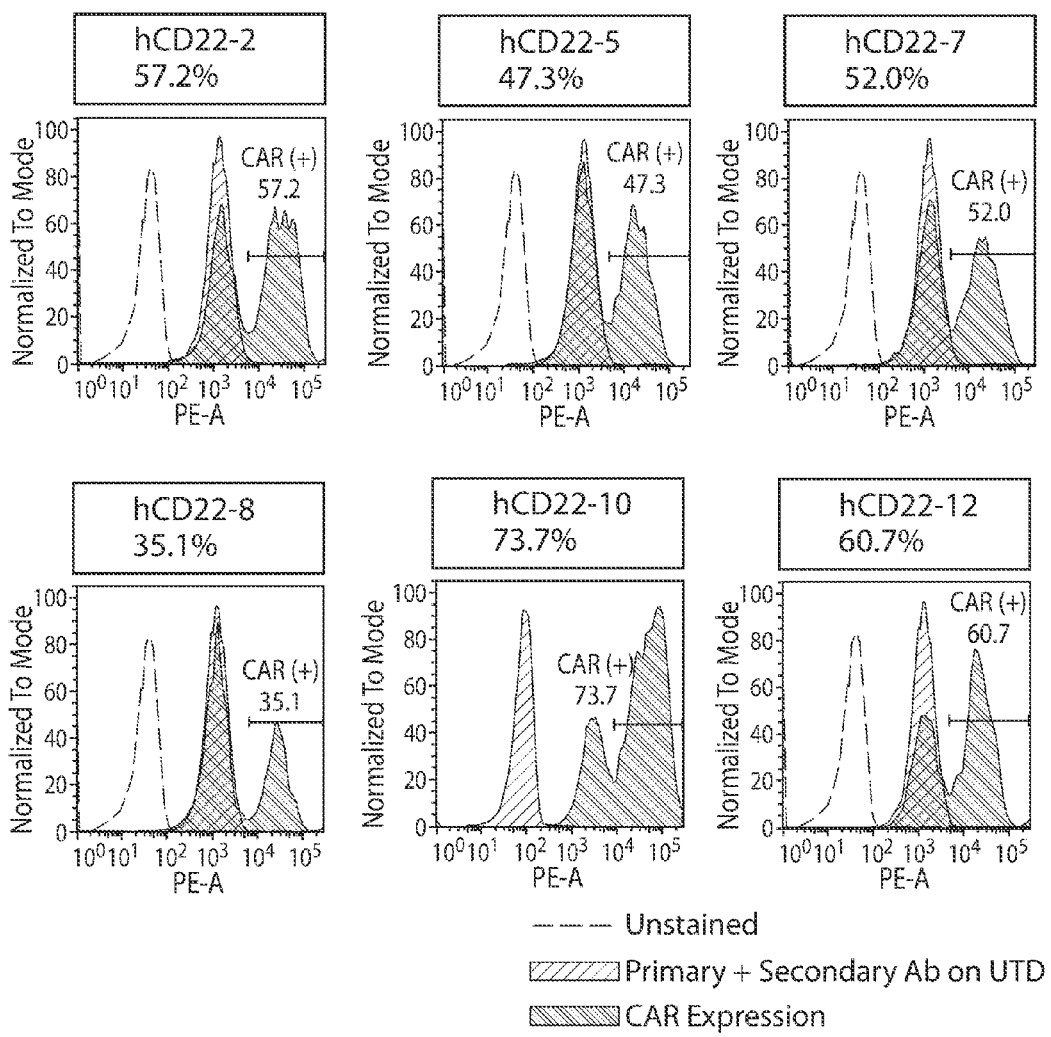
Figure 19D:
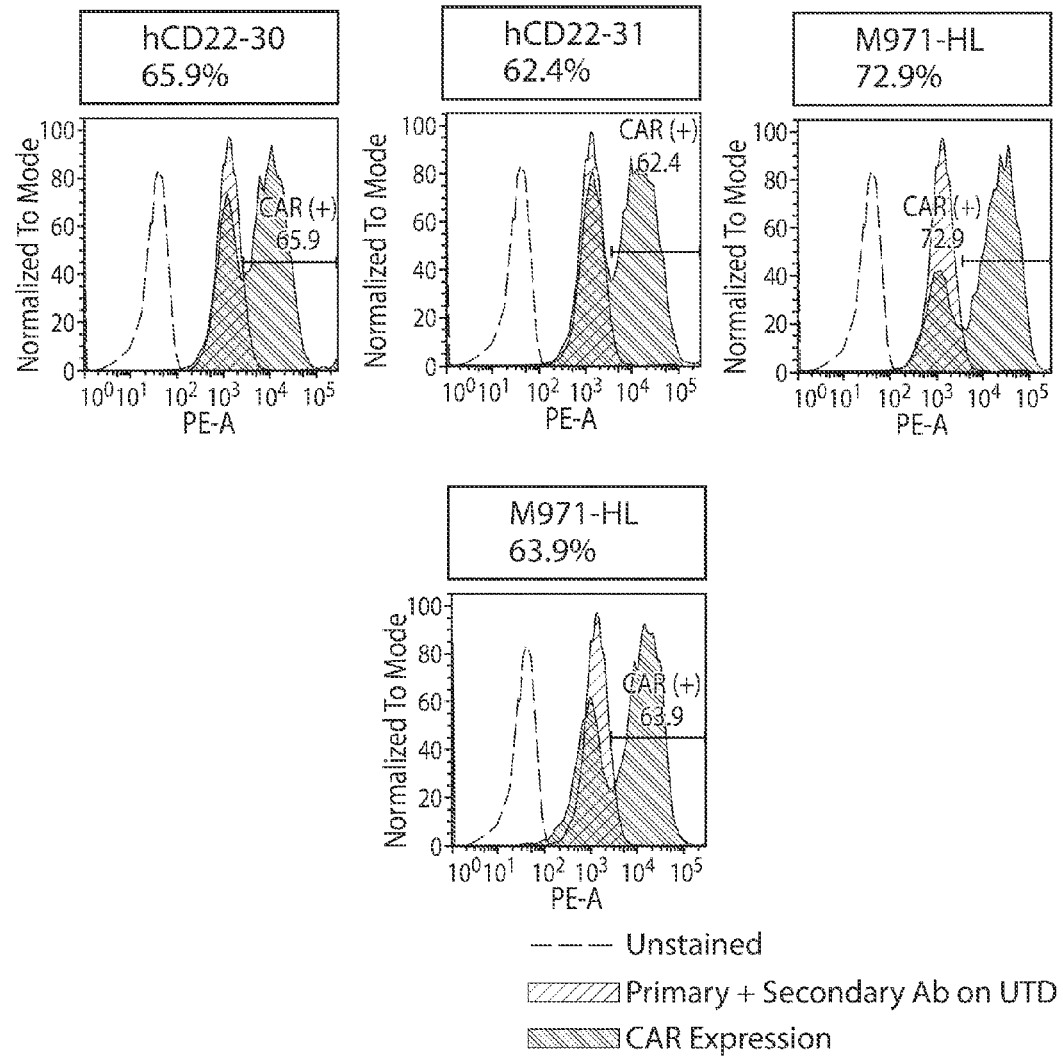
Figure 20A:
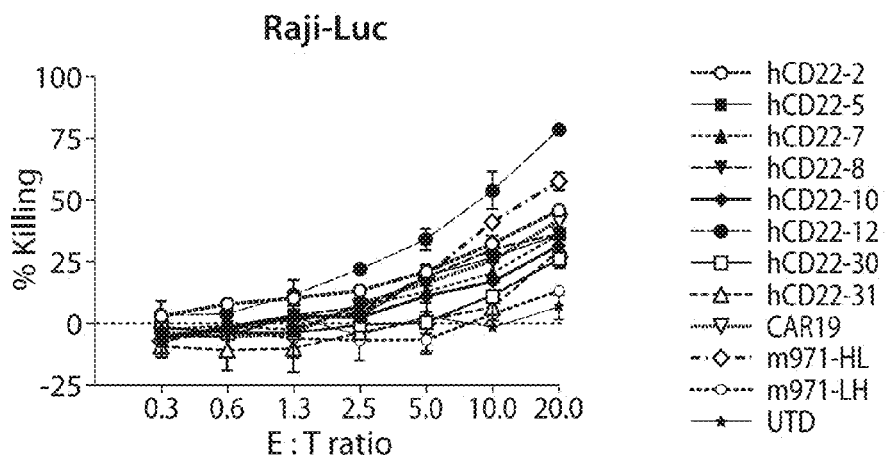
FIGS. 20A, 20B, 20C, 20D, 20E, and 20F are graphs showing a primary T-cell tumor target killing assay. Primary T-cells activated and transduced with CD22 CAR were mixed with target cell lines stably expressing luciferase at the ratios indicated and target cell killing was measured. The percent killing was normalized to hCD22-8 (28.8% transduction). CD22-expressing cell lines Raji (FIG. 20A), SEM (FIG. 20B), K562-hCD22 (FIG. 20C), Daudi (FIG. 20D), and Nalm6 (FIG. 20E) were used to test the function CD22 CAR clones in comparison with positive control CD22 CAR m971 (m971-HL), negative control CAR m971-LH, and untransduced T-cells as a negative control. K562 cell line does not express CD22 and was used as a negative control (FIG. 20F).
Figure 20B:
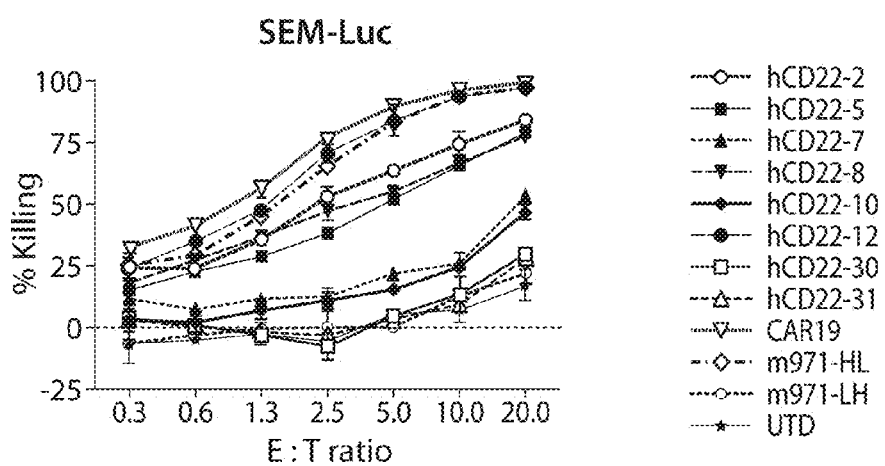
Figure 20C:
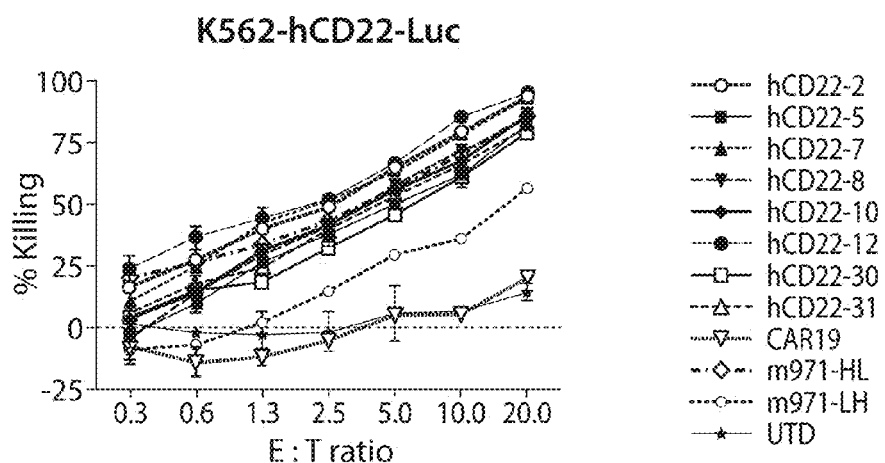
Figure 20D:
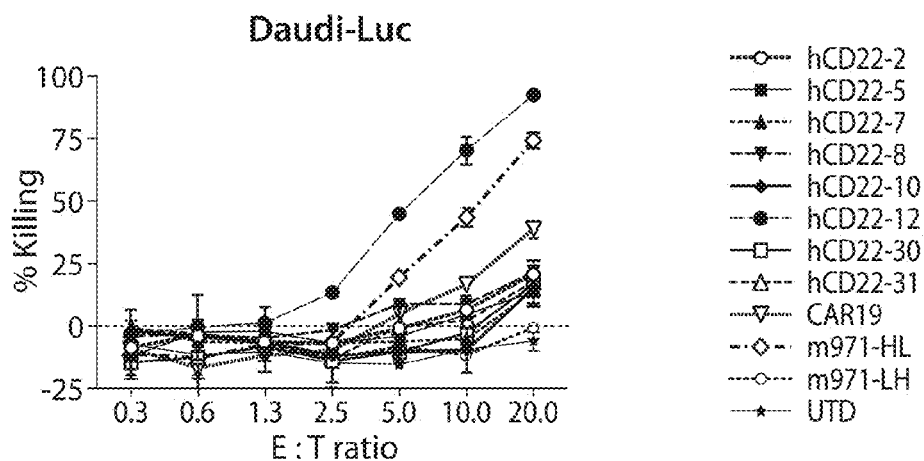
Figure 20E:
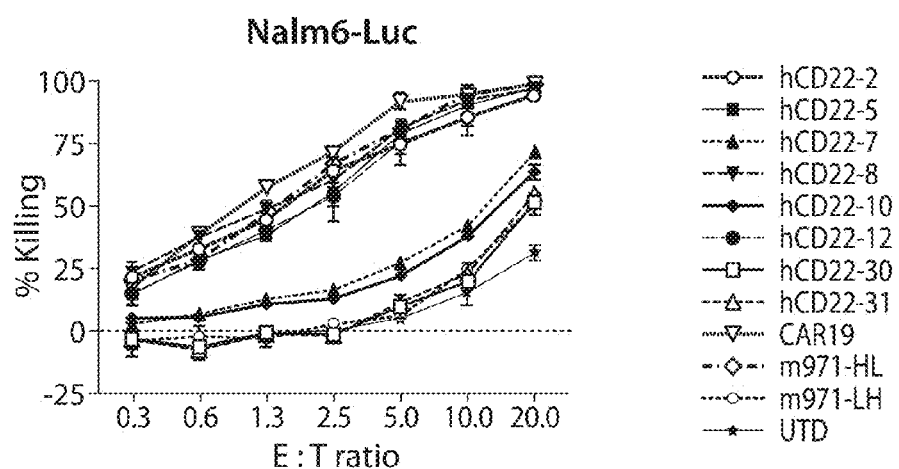
Figure 20F:
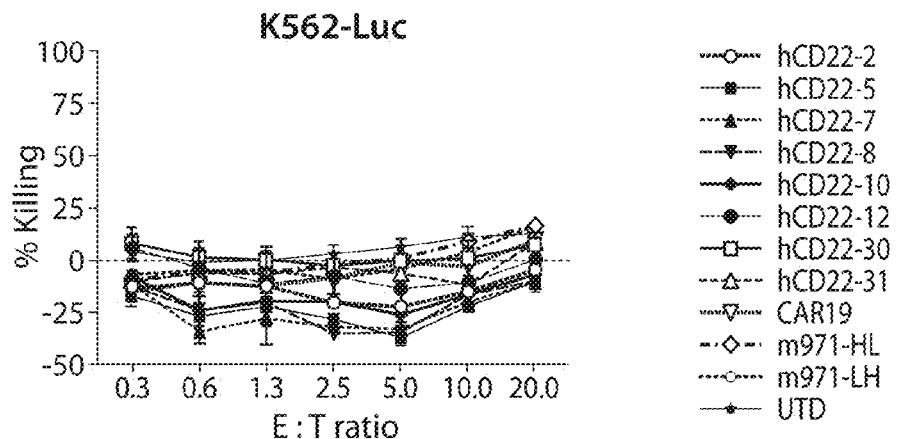
Figure 21A:
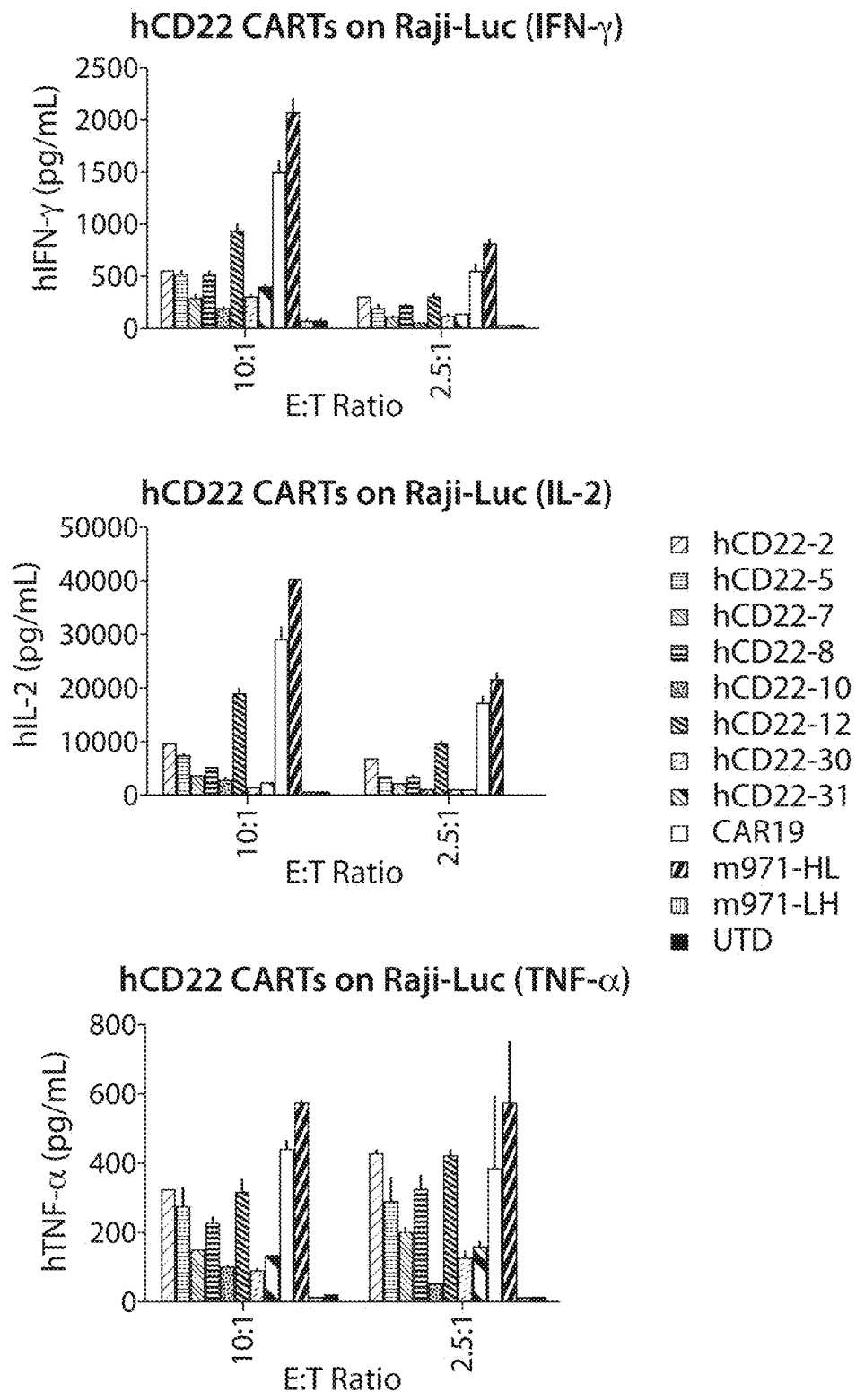
FIGS. 21A, 21B, 21C, 21D, 21E, and 21F are graphs showing induction of a significant proinflammatory cytokine response by CD22 CAR clones. Primary T-cell killing assays were used to determine the ability of CD22 CAR clone to produce the proinflammatory cytokines IFN-g, IL-2 and TNFa. Effector cells were co-cultured for 20 hours with each of the different target cell lines, normalized to 28.8% transduction. Supernatants were taken from different cultures with varying E:T ratios of 2.5:1 and 10:1 from Raji CD22 expressing target cells (FIG. 21A), Nalm6 CD22 expressing target cells (FIG. 21B), Daudi CD22 expressing target cells (FIG. 21C), SEM CD22 expressing target cells (FIG. 21D), K562-hCD22 CD22 expressing target cells (FIG. 21E), and K562 non-CD22 expressing cells (negative control) (FIG. 21F).
Figure 21B:
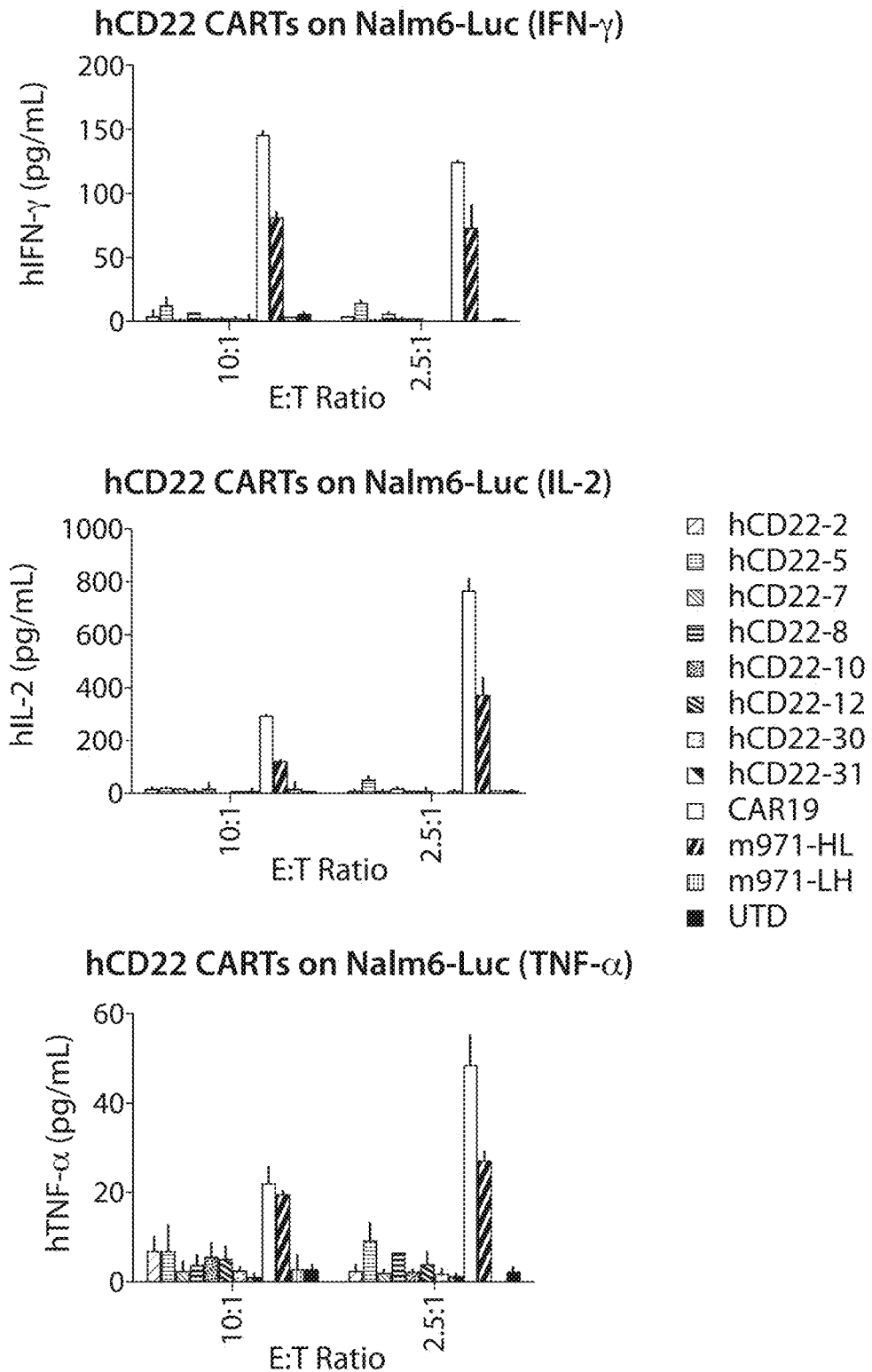
Figure 21C:
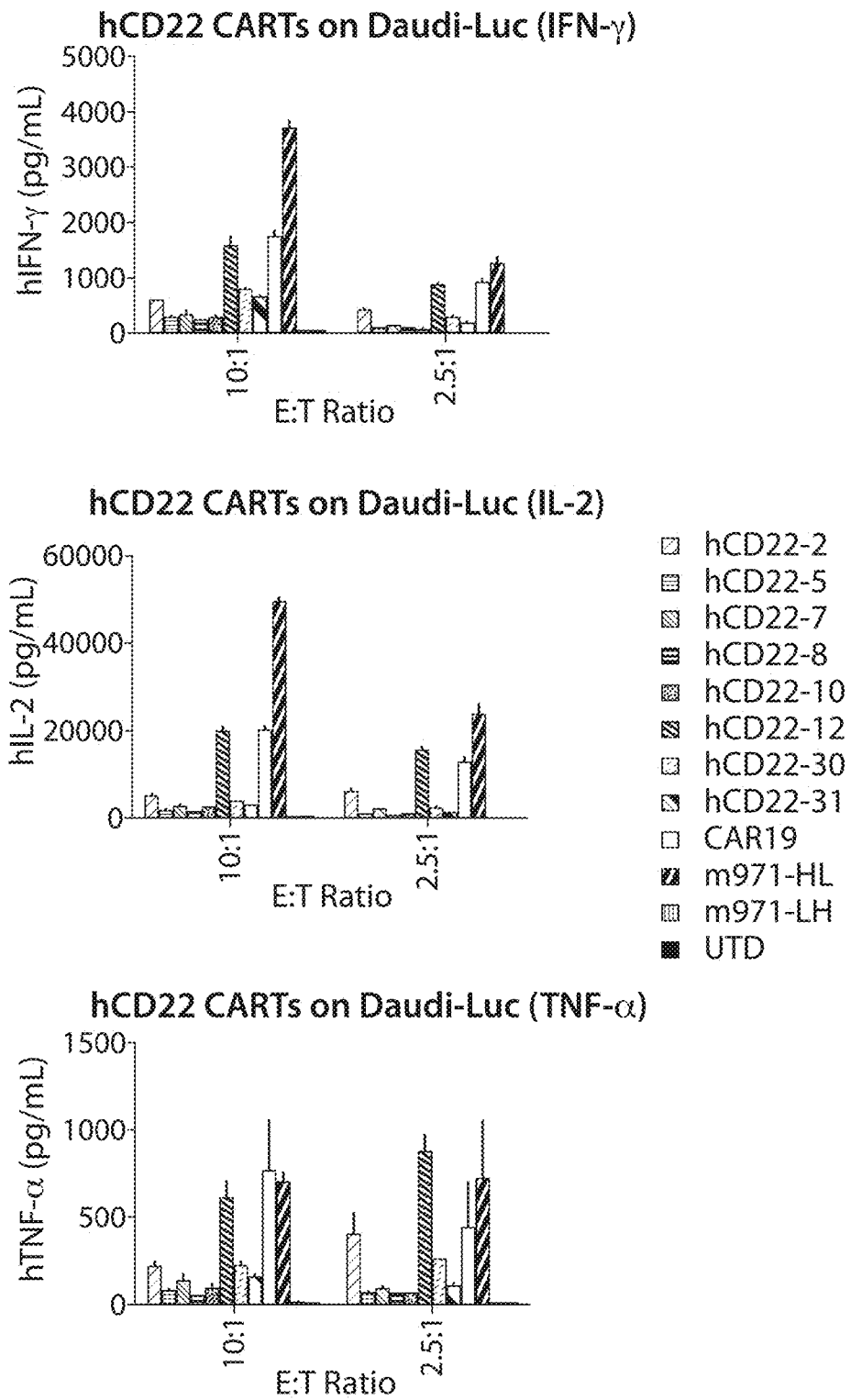
Figure 21D:
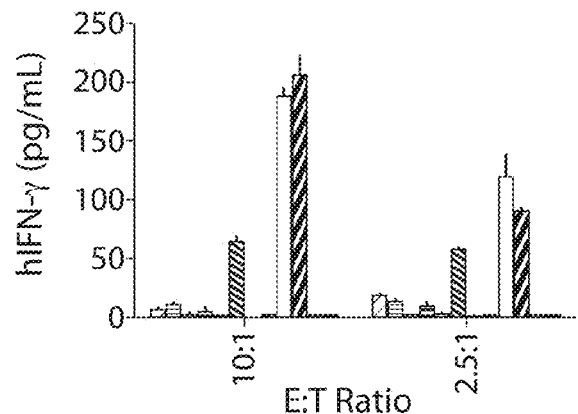
Figure 21D:
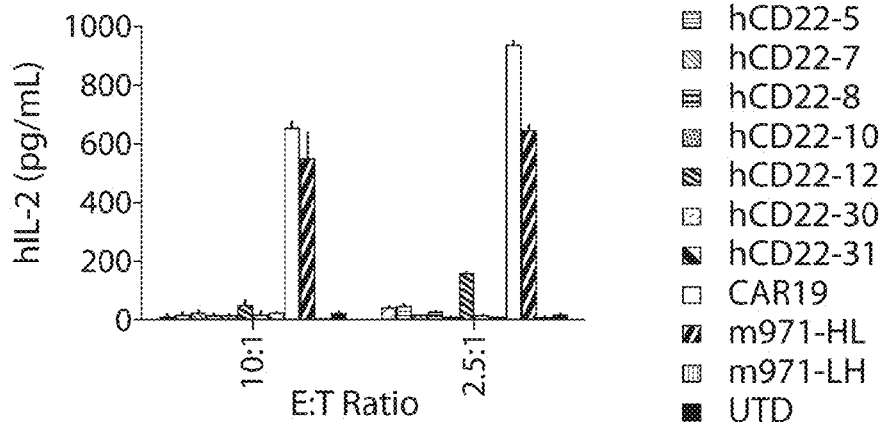
Figure 21D:
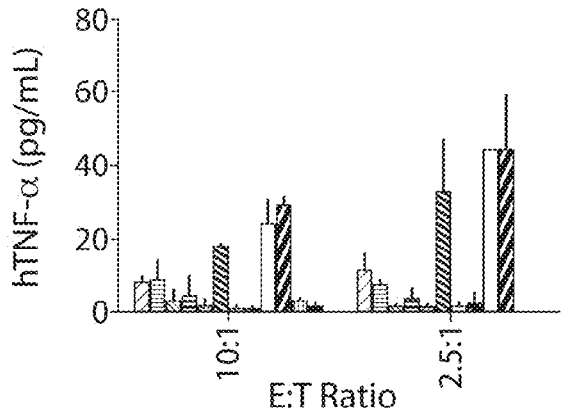
Figure 21E:
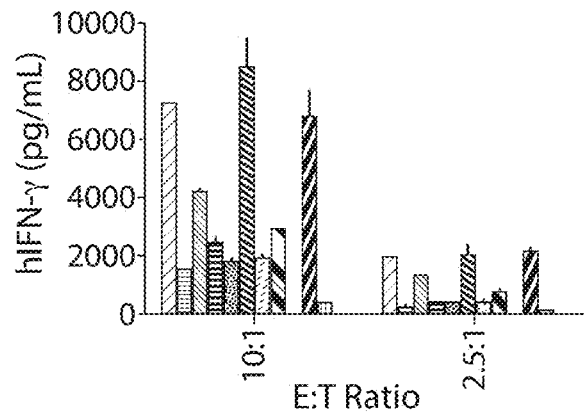
Figure 21E:
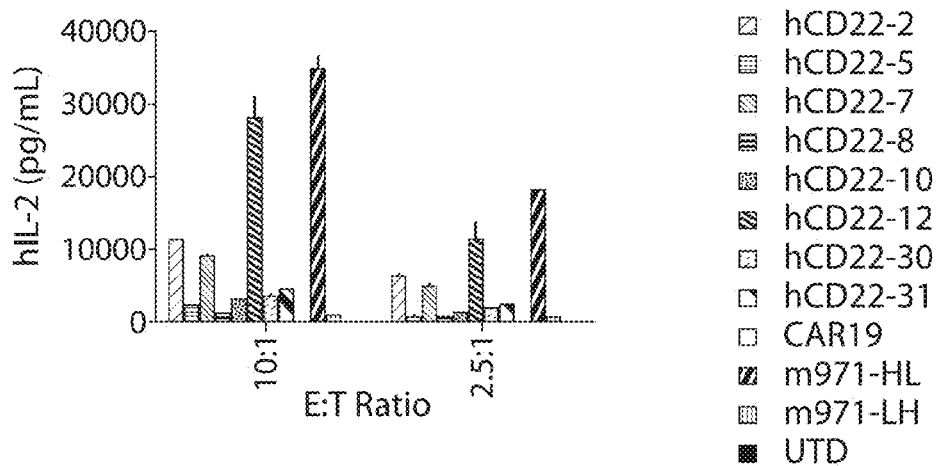
Figure 21E:
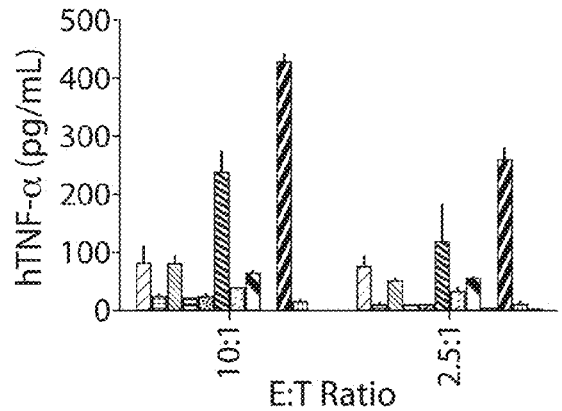
Figure 21F:
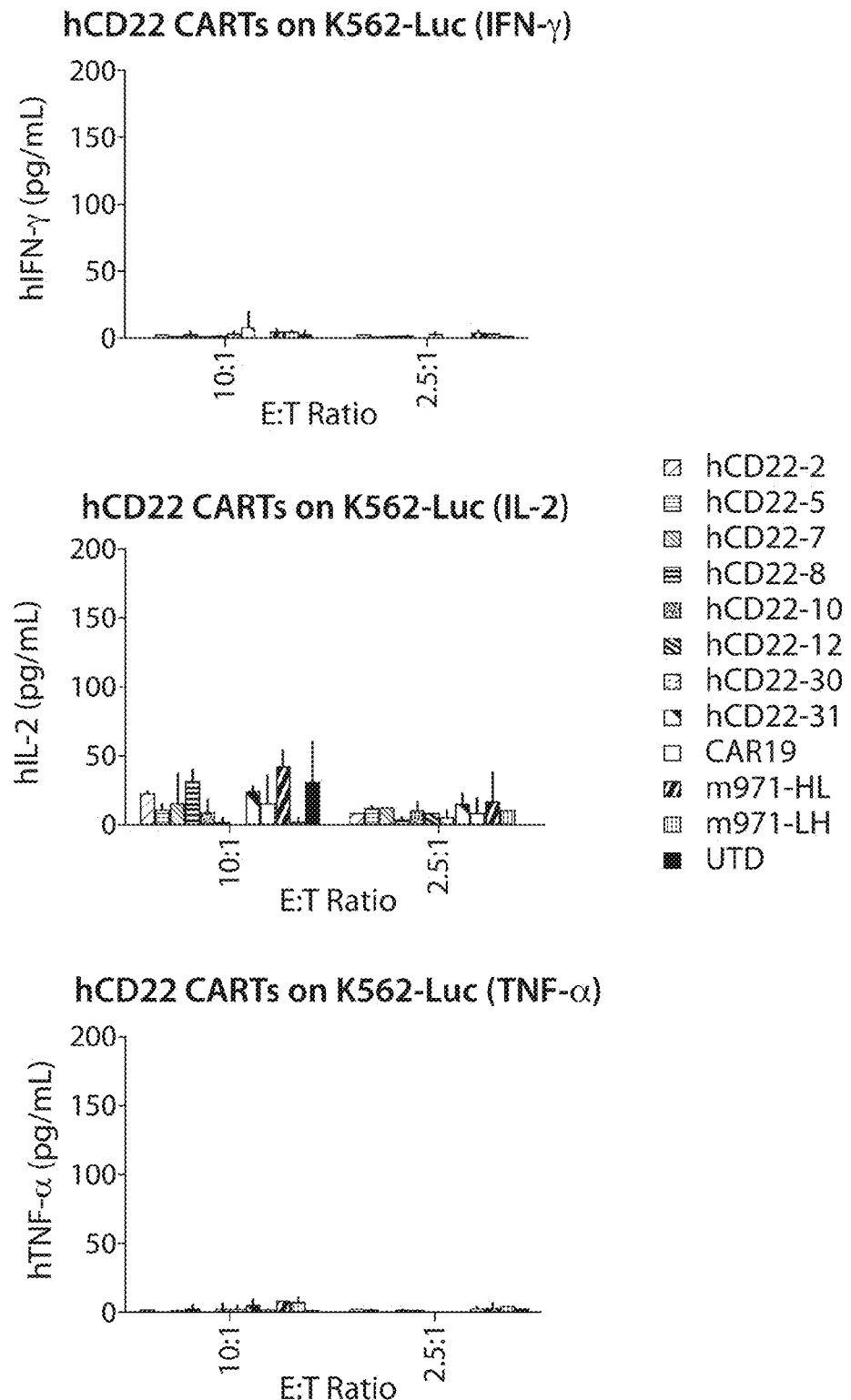

An automated assay was performed to determine reactivity of specific CD22 CART clones. $3e^4$ lentivirally-transduced Jurkat cell line cells stably expressing luciferase from an NFAT promoter (JNL cells) were plated in a 96 well plate with CD22-expressing target cell lines (Daudi, Raji) and a non-CD22 expressing cell line (K562) as a negative control. The next day, luciferin substrate was added to each well of the 96 well plate and relative luminescence of the luciferase reporter was determined. In this assay, CD22 CAR constructs were compared to a CD19 CAR construct and a CD22 (m971-derived) CAR construct (m971-HL) that served as positive controls. A m971-LH CAR construct, which contains the VH and VL chains of m971-HL but in reverse orientation (L-H instead of H-L), contained a CAR but was unable to bind target due to lack of specificity and served as a negative control. Untransduced T-cells containing no CAR (Neg cnt) also served as a negative control. Luciferase activity from Jurkat T-cell activation was graphed. The results presented herein demonstrate that several of the CD-22 transduced JNL clones showed specific reactivity towards the CD22-expressing cell lines that increased in a dose-dependent manner (FIGS. 18A-18C).

Expression of CD22 CAR in Primary Human T-Cells

Primary human T-cells were activated with anti-CD3/antiCD28 stimulatory beads on day 0, followed by lentiviral transduction of specified CAR constructs on day 1. Cells were expanded in vitro until day, 10 at which point they were analyzed by flow cytometry for surface expression of CAR. Two different approaches were utilized to determine surface expression of CAR: Protein-L-biotin followed by streptavidin-PE, and recombinant human CD22-Fc followed by anti-Fc-alexafluor 488. The results are shown in FIGS. 19A, 19B, 19C, and 19D. The results presented herein demonstrate that CD22 CAR clone 2 (hCD22-2), clone 5 (hCD22-5), clone 7 (hCD22-7), clone 8 (hCD22-8), clone 10 (hCD22-10), clone 12 (hCD22-12), clone 30 (hCD22-30), and clone 31 (hCD22-31) showed positive surface expression. CD22 CAR m971 served as a positive control for binding both Protein-L and hrCD22-Fc, and Isotype CAR with no specificity (anti-gH) served as a positive control for Protein-L. T cells expressing no CAR were used as a negative control.

Primary T-Cell Tumor Target Killing Assay

Primary T-cells activated and transduced as described above were mixed with target cell lines stably expressing luciferase at the ratios indicated (FIG. 20A-20F). Target cell lines Raji, SEM, K562-hCD22, Daudi, and Nalm6 all expressed CD22 target, whereas the K562 cell line did not express CD22 and served as a negative control (FIG. 20A-20F). The results presented herein demonstrate that several CD22 CAR clones (e.g., CD22 CAR clones 2, 5, 7, 8, 10, 12, 30, and 31) and positive control CD22 m971-HL CAR exhibited dose-dependent target cell killing, with extent of killing varying depending on target cell type. Untransduced T-cells (UTD) lacked the ability to kill target cell lines.

Primary T-Cell Cytokine Bead Array

The ability of CD22-expressing cell lines to induce release of proinflammatory cytokines from CD22-expressing CART cells was investigated. Proinflammatory cytokine concentration was determined using a cytokine bead array kit on samples taken from the primary T-cell killing assay. Interferon-g (IFN-g), Tumor necrosis factor alpha (TNFa), and interleukin 2 (IL-2) were all measured on samples from 2.5:1 E:T and 10:1 E:T ratios. The results are shown in FIG. 21A-21F. The results presented herein demonstrate that multiple CD22 CAR clones induced significantly more IFN-g, TNFa and IL-2 than the m971-LH CAR (negative control) or untransduced T-cells (UTD), with cytokine induction levels varying by target cell type.

Example 10: Dose Escalation Study of CD22 CART Treatment

A phase 1 clinical trial is performed to determine the optimal dose of CD22 CART with or without CD19 CART in ALL subjects who have and have not previously received CART therapy. The purpose of this study is to determine the feasibility of producing anti-CD22 CAR engineered T cells meeting the established release criteria and to assess the safety of administering escalating doses of autologous anti-CD22 CAR engineered T cells in children and young adults with B cell malignancies following a cyclophosphamide/fludarabine lymphodepletion regimen.

Subjects are between 1 and 30 years of age and weighing at least 15 kg with CD22+ ALL. Disease activity is measurable by bone marrow analysis or FDG-PET. Subjects with minimal residual disease activity are allowed. Subjects with a central nervous system (CNS) status of 1 or 2 are allowed. Subjects must have adequate organ function and adequate CD3 count.

A phase 1 dose escalation study with an expansion cohort is performed. Subjects are stratified according to whether they have or have not previously received CART therapy. Subjects are given one of four dose levels of four doses of autologous anti-CD22 CAR engineered T cells: $3 \times 10^5$ cells/kg body weight, $1 \times 10^6$ cells/kg body weight, $3 \times 10^6$ cells/kg body weight and $1 \times 10^7$ cells/kg body weight. A subset of the subjects receiving the $3 \times 10^6$ cells/kg body weight dose are also given anti-CD19 CAR engineered T cells. The first 2 patients at each dose level are 16 years of age or older.

After eligibility is determined, apheresis is performed to isolate T cells. Subjects then undergo preparative chemotherapy. Subjects are treated with 25 mg/m$^2$ fludarabine daily for three days and given a single dose of 900 mg/m$^2$ of cyclophosphamide. Anti-CD22 CAR engineered T cells are then administered and 28 days later response and toxicity are evaluated.

Figure 15A:
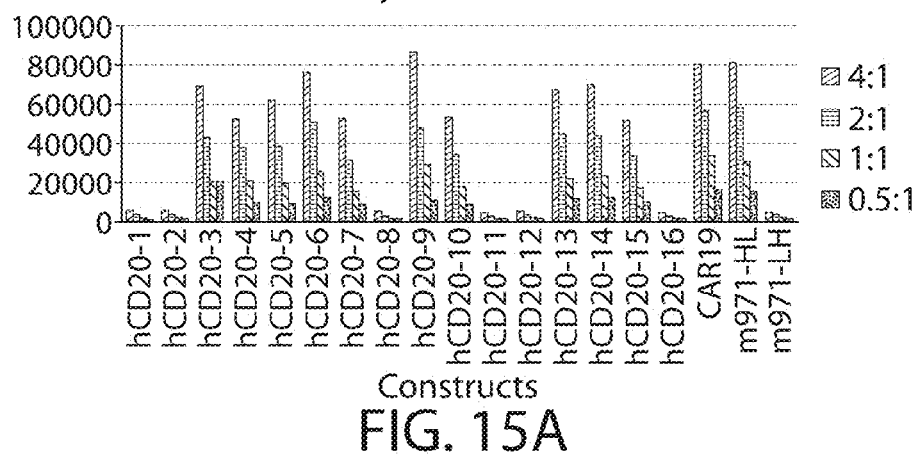
FIGS. 15A, 15B, and 15C are graphs showing the extent of CAR T-cell activation (measured by relative luminescence) in the presence of various tumor target cell lines.
Figure 15B:
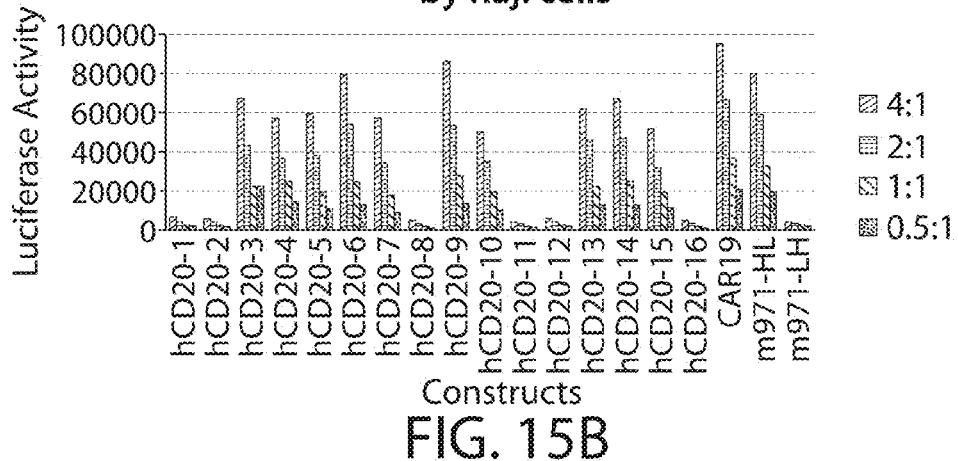
Figure 15C:
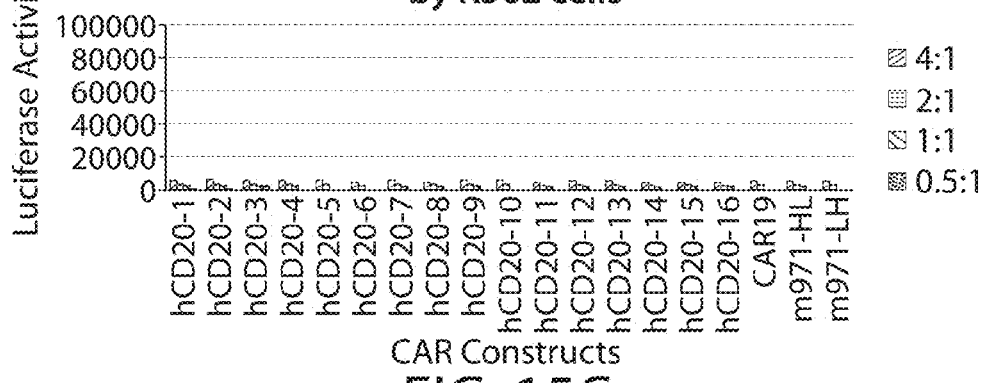

Example 11: Utilization of CD20-Targeting Chimeric Antigen Receptors (CARS) for the Treatment of B-Cell Malignancies A Jurkat-NFAT-Luciferase (JNL) cell assay was performed to determine reactivity of specific CD20 CART clones. Jurkat cells stably expressing luciferase from an NFAT promoter (JNL cells) were lentivirally transduced with CAR constructs shown in FIG. 15A-15C. CAR-expressing JNL cells (3e4) were mixed with CD20 expressing target cell lines Daudi (FIG. 15A) and Raji (FIG. 15B), and a non CD20 expressing negative control K562 (FIG. 15C) at effector cell:target cell (E:T) ratios of 0.5:1, 1:1, 2:1, and 4:1. Lentivirally transduced JNL cells were plated in a 96 well plate with CD20-expressing target cell lines (Daudi, Raji) and a non-CD20 expressing cell line (K562) as a negative control. The next day, luciferin substrate was added to each well of the 96 well plate, and relative luminescence of the luciferase reporter (from Jurkat T-cell activation) was determined. In this assay, CD20 CAR constructs were compared to a CD19 CAR construct and a CD22 (m971-derived) CAR construct described in Haso et al., Blood, 14 Feb. 2013, Vol. 121, No. 7 that served as positive controls. Isotype CAR, which contained a CAR but was unable to bind target due to lack of specificity, and untransduced T-cells containing no CAR (Neg cnt) served as negative controls. The results are shown in FIG. 15A-15C. Several of the CD20 transduced JNL clones showed specific reactivity towards the CD20-expressing cell lines that increased in a dose-dependent manner.

Example 12: Identification of Factors that Predict Subject Relapse to CD19CART Therapy in B-Cell Acute Lymphocytic Leukemia (B-ALL)

The present Example describes, among other things, the identification of novel transcriptional gene signatures that predict patient relapse to CD19CART therapy (e.g., CTL019 therapy) in B cell Acute Lymphocytic Leukemia (B-ALL), for use in accordance with the present invention.

Among other things, the present Example describes novel gene signatures based on mRNA expression levels of selected genes in the patient prior to CD19CART treatment (e.g., CTL019) (apheresis or bone marrow) or in manufactured CD19CART product samples (e.g., CTL019) prior to re-infusion. In an embodiment, the present example describes novel gene signatures that discriminate relapsers to CTL019 therapy in B-ALL from non-relapsers to CTL019 therapy in B-ALL.

The present Example describes methods of unbiased feature selection to discover novel gene signatures that predict subject relapse to CD19CART therapy (e.g., CTL019) in B-ALL, for use in accordance with the present invention.

The present Example also describes methods of Gene Set Analysis to discover novel gene signatures, for use in accordance with the present invention.

Novel gene signatures based on mRNA expression levels in manufactured CD19CART product samples prior to re-infusion were identified that predict subject relapse to CD19CART therapy in B cell Acute Lymphocytic Leukemia (B-ALL). The identified signatures were discovered in a whole genome RNAseq study of manufactured product samples which included 7 B-ALL subject samples. B-ALL subject samples (7 total) were stratified as follows: biological samples were taken from 4 subjects who did not relapse ("non-relapsers") following CTL019 therapy, and 3 subjects who did relapse ("relapsers") following CTL019 therapy. Several gene signatures discriminating responders from non-responders, and relapsers from non-relapsers, in manufactured product samples were discovered and are described further in detail below.

Novel gene signatures were then discovered using various data analytical approaches: 1) unbiased feature selection; 2) gene set analysis; and 3) differential expression analysis of selected genes of interest.

Figure 32A:
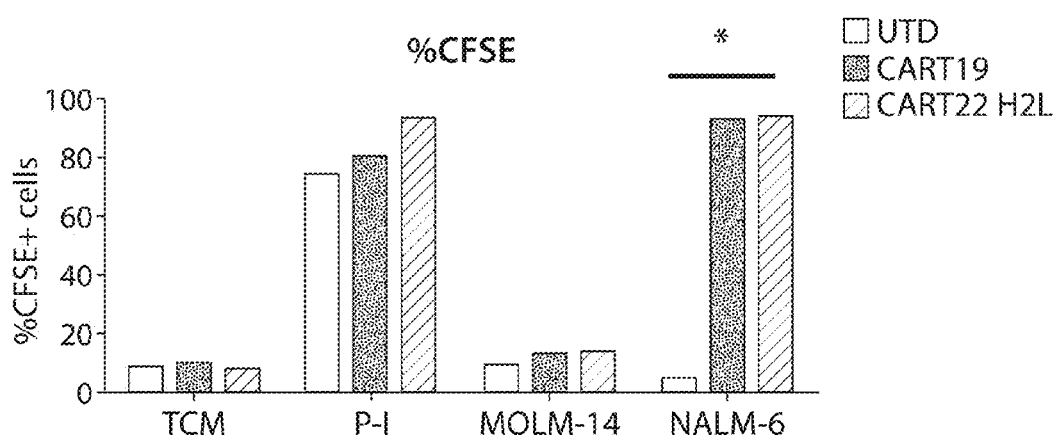
FIGS. 32A and 32B are a series of graphs showing a CFSE-based proliferation assay. Co-culture for 5 days of CART22 and CART19 with the ALL cell line NALM-6 led to significant T cell proliferation (94% and 92.9% respectively). Controls are also shown (TCM=media alone, P-I=PMA/Ionomycin, MOLM-14) (FIG. 32A). In histograms showing the dynamics of CFSE dilution in CART19 and CART22, most of T cells underwent multiple proliferative cycles (FIG. 32B). Gating strategy: FSS vs SSC lymphocytes→singlets→live→CD3+.
Figure 32B:
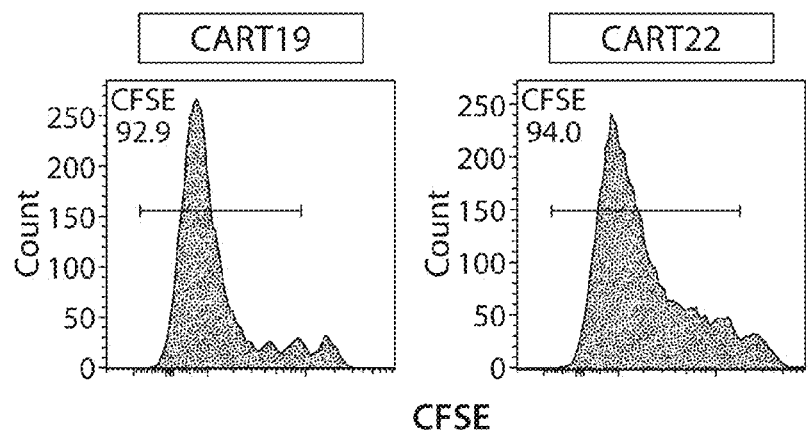

Novel gene signatures derived from unbiased feature selection were discovered by determining which genes were differentially expressed between the 2-group comparison of relapsers and non-relapsers which compared the 3 relapsers to the 4 non-relapsers. Genes were defined as differentially expressed if their differential expression was statistically significant in the 2-group comparison with a FDR p-value cutoff of 0.25. The gene list for the relapser versus non-relapser comparison (N=17) is tabulated in Table 29. 2-group statistical models were applied to determine whether the meta-gene was statistically different between the groups and an exemplary schematic illustrating the approach is illustrated in FIGS. 32A and 32B. FIGS. 32A and 32B depict an exemplary heat map of genes upregulated in activated $T_{EFF}$ versus resting $T_{EFF}$ cells for complete responders (CR), partial responders (PR), and non-responders (NR) with CLL.

Figure 17:
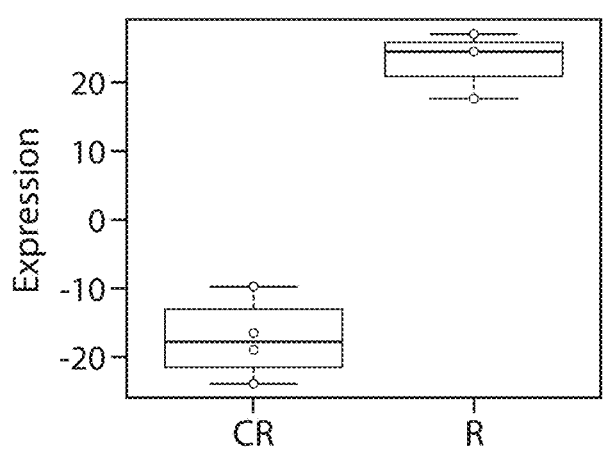
FIG. 17 depicts exemplary results (p=0.000215) illustrating that $T_{REG}$ genes have high expression levels in samples from pediatric patients who were complete responders who became relapsers (R) compared to complete responders (CR) who did not relapse. The x-axis is samples by response group where CR=complete responder without relapse and R=relapser. The y-axis is normalized meta-gene expression scores.

Without wishing to be bound by a particular theory, these data indicate that the differentiation state of T cells in CD19CART product (e.g., CTL019) correlate with subject response (i.e., CR, PR, or NR) and predict subject relapse to CD19CART therapy (e.g., CTL019 therapy) in B-ALL. Complete responders gene signatures are more like resting $T_{REG}$ and $T_{EFF}$ cells. Among other things, gene signatures for relapsers (e.g., a complete responder that relapses to CTL019 therapy) contain genes upregulated in $T_{REG}$ versus $T_{EFF}$ cells at resting. Without wishing to be bound by a particular theory, these data indicate that relapsers to CART therapy (e.g., CTL019) in B-ALL have higher levels of $T_{REG}$ compared to non-relapsers to CART therapy (e.g., CTL019). FIG. 17 depicts exemplary results illustrating that $T_{REG}$ are differentially enriched in relapsers (R) versus non-relapsers, e.g., relapsers express high levels of $T_{REG}$ genes compared to complete responders (CR) (e.g., non-relapsers).

TABLE 29

Exemplary Genes that Predict Patient Relapse to CTL019 Therapy

| Gene | MiRBase | Unigene | Accession No. | FDR |
|---|---|---|---|---|
| MIR199A1 | MI0000242 |  | NR_029586.1 | 2.11E−05 |
| PPIAL4D |  | Hs.730589 | NM_001164261.1 | 3.94E−05 |
| MIR1203 | MI0006335 |  | NR_031607.1 | 4.63E−03 |
| uc021ovp |  |  |  | 6.73E−03 |
| ITM2C |  | Hs.111577 | NM_001012514.2 | 1.17E−01 |
|  |  |  | NM_001012516.2 |  |
|  |  |  | NM_001287240.1 |  |
|  |  |  | NM_001287241.1 |  |
|  |  |  | NM_030926.5 |  |
| HLA-DQB1 |  | Hs.409934 | NM_001243961.1 | 1.17E−01 |
|  |  | Hs.534322 | NM_001243962.1 |  |
|  |  |  | NM_002123.4 |  |
| TTTY10 |  | Hs.461175 | NR_001542.1 | 1.25E−01 |
| TXLNG2P |  | Hs.522863 | NR_045128.1 | 2.27E−01 |
|  |  |  | NR_045129.1 |  |
| MIR4650-1 | MI0017277 |  | NR_039793.1 | 2.27E−01 |

TABLE 29-continued

Exemplary Genes that Predict Patient Relapse to CTL019 Therapy

| Gene | MiRBase | Unigene | Accession No. | FDR |
|---|---|---|---|---|
| KDM5D | | Hs.80358 | NM_001146705.1 | 2.27E−01 |
| | | | NM_001146706.1 | |
| | | | NM_004653.4 | |
| USP9Y | | Hs.598540 | NM_004654.3 | 2.27E−01 |
| PRKY | | Hs.584730 | NR_028062.1 | 2.27E−01 |
| RPS4Y2 | | Hs.367761 | NM_001039567.2 | 2.27E−01 |
| RPS4Y1 | | Hs.282376 | NM_001008.3 | 2.27E−01 |
| NCRNA00185 | | Hs.138453 | NR_001543.3 | 2.28E−01 |
| | | Hs.729534 | NR_125733.1 | |
| | | Hs.734681 | NR_125734.1 | |
| | | | NR_125735.1 | |
| | | | NR_125736.1 | |
| | | | NR_125737.1 | |
| SULT1E1 | | Hs.479898 | NM_005420.2 | 2.33E−01 |
| EIF1AY | | Hs.461178 | NM_001278612.1 | 2.38E−01 |
| | | | NM_004681.3 | |

The following genes showed increased levels in relapsers and decreased levels in non relapsers: MIR199A1, MIR1203, uc021ovp, ITM2C, and HLA-DQB1. The following genes showed decreased levels in relapsers and increased levels in non relapsers: PPIAL4D, TTTY10, TXLNG2P, MIR4650-1, KDM5D, USP9Y, PRKY, RPS4Y2, RPS4Y1, NCRNA00185, SULT1E1, and EIF1AY.

Gene set analysis yielded a number of gene signatures predictive of subject relapse to CTL019 therapy in B-ALL.

Among other things, the present Example describes novel gene signatures based on Gene Set Analysis, that are predictive of patent relapse to CD19CART therapy (e.g., CTL019) in B-ALL. Gene set analysis was performed on three gene sets i.e., gene sets were sourced from (1) additional experiments were based on unpublished experiments by Szabo et al., (described below); (2) gene sets published by Abbas et al. in Genome Research 2005; and (3) gene sets published by Gattinoni et al. in Nature Medicine 2011. The gene sets defined by Szabo, Abbs, and Gattinoni and considered in this analysis described in Example 1 of U.S. Provisional Patent App. 62/061,553.

The Szabo core gene set includes the following genes which are upregulated in Teff cells (16 h v 0 h): AIM2, ALAS1, B4GALT5, BATF, C3orf26, C4orf43, CCL3, CCL4, CCT3, CCT7, CD40LG, CHAC2, CSF2, CTNNA1, EBNA1BP2, EDARADD, EEF1E1, EIF2B3, EIF2S1, FABP5, FAM40B, FKBP4, FOSL1, GFOD1, GLRX2, HSPD1, HSPE1, IFNG, IL15RA, IL21, IL2RA, IL3, KCNK5, KIAA0020, LARP4, LRP8, LTA, MANF, MIR1182, MIR155, MIR155HG, MTCH2, MYOF, NDUFAF1, NLN, NME1, NME1-NME2, OTUD7B, PAM, PDIA6, PEA15, PFKM, PGAM1, PGAM4, PPIL1, PRDX4, PRSS23, PSMD1, PSMD11, PSMD14, PTRH2, PUS7, RBBP8, RPF2, RPP25, SFXN1, SLC27A2, SLC39A14, SLC43A3, SORD, SPR, SRXN1, STIP1, STT3A, TBX21, TMCC2, TMEM165, TNFRSF9, TXN, TXNDC5, UCK2, VDR, WDR12, YWHAG, and ZDHHC16. The Szabo core gene set also includes the following genes which are upregulated in Treg cells (16 h v 0 h): AIM2, ALAS1, BATF, C5orf32, CCL17, CD40LG, CHAC2, CSF1, CTSL1, EBNA1BP2, EDARADD, EMP1, EPAS1, FABP5, FAM40B, FKBP4, FOSL1, GCLM, GK, GPR56, HMOX1, HSPD1, HSPE1, IKBIP, IL10, IL13, IL15RA, IL1RN, IL2RA, IL3, IL4, IL5, IL9, KCNK5, LTA, MANF, MIR1182, MIR155, MIR155HG, MYOF, NDUFAF1, NLN, NME1, NME1-NME2, PANX2, PDIA6, PGAM4, PPIL1, PPPDE2, PRDX4, PRKAR1B, PSMD1, PSMD11, PUS7, RBBP8, SLC27A2, SLC39A14, SLC43A3, SRXN1, STIP1, STT3A, TBX21, TNFRSF11A, TNFRSF1B, TNFRSF8, TNFRSF9, TXN, UCK2, VDR, VTRNA1-3, WDR12, YWHAG, ZDHHC16, and ZNF282.

Each gene set (e.g., Szabo gene sets, Abbas gene sets, and Gattinoni gene sets) was evaluated to determine its association with subject response (i.e., relapser or non-relapser) in the following manner: a meta-gene was calculated for each subject, where the meta-gene score for subject j was defined as $$m_j = \Sigma_{i=G}^{1} x_{ij} - \mu(x_j)/\sigma(x_j)$$

where $x_{ij}$ is the expression value of gene i in subject j for a given gene set n=1, . . . , G; $\mu(x_j)$ is the mean of genes 1, . . . , G in subject j; and $\sigma(x_j)$ is the standard deviation of genes 1, . . . , G in subject j.

Figure 16:
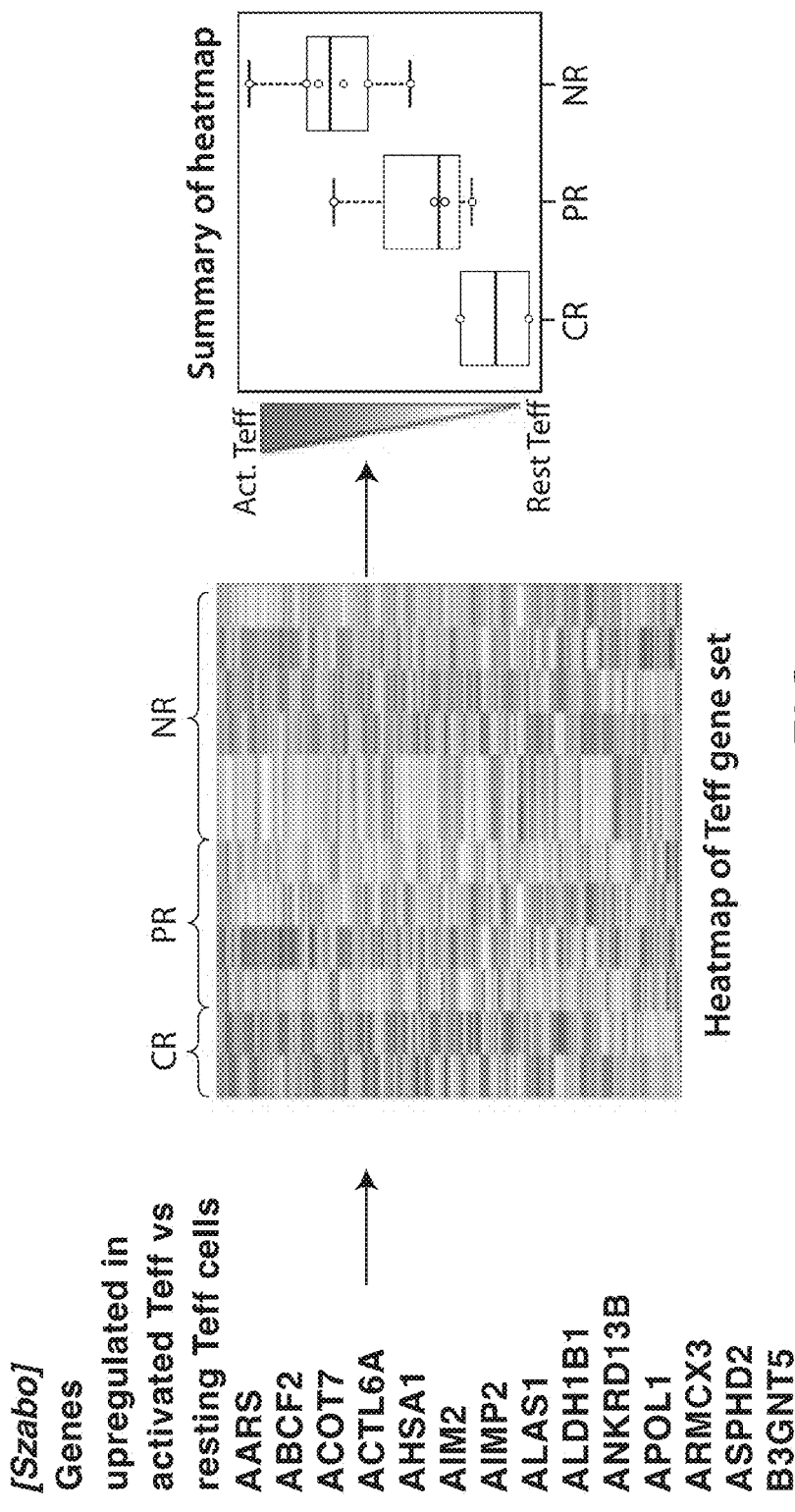
FIG. 16 is an exemplary schematic illustrating an overview of the gene signature analysis. Briefly, for each gene set, a 2-group statistical model was applied to determine whether the meta-gene was statistically different between the CRs, PRs, and NRs. CRs are more like resting $T_{EFF}$ cells, whereas NR are more like activated $T_{EFF}$ cells. Genes upregulated in activated versus resting $T_{EFF}$ cells are also upregulated in NRs.

A 2-group statistical model was applied to each gene set to determine whether the meta-gene was statistically different between the manufactured CTL019 product of relapsers and non-relapsers. A schematic illustrating this approach is given in FIG. 16. Of the Szabo, Abbas, and Gattinoni gene sets, there was one gene set that was significantly differentially enriched between relapsers and non-relapsers. This gene set was from the Szabo collection and contains genes upregulated in $T_{REG}$ versus $T_{EFF}$ cells at resting, and correlated with patient relapse to CTL019 therapy. Specifically, this gene set was found to be enriched in relapsers, indicating that relapsers have higher levels of $T_{REGS}$ compared to non-relapsers. For example, the meta-gene score for the gene set comprised of genes upregulated in $T_{REG}$ in comparison to $T_{EFF}$ cells is found to be correlated with patient relapse in product samples (see FIG. 17). FIG. 17 depicts exemplary results (p=0.000215) illustrating that $T_{REG}$ genes have high expression levels in relapsers (R) compared to non-relapser, complete responders (CR). The x-axis is samples by response group where CR=complete responder and R=relapser. The y-axis is normalized meta-gene expression scores.

Without wishing to be bound by a particular theory, these data indicate that decreasing the $T_{REG}$ signature in the patient prior to apheresis or during manufacturing of the CART product significantly reduces the risk of patient relapse.

Example 13: Insertion Mutations are a Mechanism of Resistance to CTL019 Therapy in B Cell Acute Lymphoid Leukemia (B-ALL)

Several resistance mechanisms have been discovered by comparing the mRNA sequencing data from B-ALL patient samples taken at baseline and after relapse. Certain resistance mechanisms are referred to as "CD19− relapse", i.e. the patient's tumor cells are characterized as CD19− since they do not bind to the FMC63 epitope used in CTL019 as measured by flow cytometry. Several resistance mechanisms have been discovered and are described in detail in this Example.

mRNA sequencing (RNAseq) was performed to compare the transcriptional profiles of B-ALL patients before CTL019 treatment and after relapse. Three patients were considered: one patient (Patient #29), who was CD19− at the time of relapse, and two patients (Patients #104 and #105), who were CD19+ at relapse. See Table 30 below for a list of patients, their classification, and percentage of leukemia at both time points.

TABLE 30

| Sample | Type of relapse | % Leukemia in BM, baseline | % Leukemia in BM, relapse |
| --- | --- | --- | --- |
| Patient #29 | CD19− | N/A | N/A |
| Patient #104 | CD19+ | 33% | 98.5% |
| Patient #105 | CD19+ | 46% pre-CART | 65% |

Analysis of the RNAseq data for the CD19 gene revealed several noteworthy observations.

Three insertions were found in exon 2 of CD19. The insertions were only found in the relapse sample for patient #29. No reads supporting any of the three insertions, or any other insertion in exon 2 of CD19, were observed in the other two patients and at baseline for patient #29. The genomic locations and actual insertions are tabulated in Table 31 below.

TABLE 31

| Insertion | Location | Wild Type | Inserted Sequence |
| --- | --- | --- | --- |
| 1 | 28943706 | C | C -> CA |
| 2 | 28943707 | A | A -> AT |
| 3 | 28943811 | T | T -> TTTGG |

The lengths of the three insertions are 1, 1, and 4 bases long respectively and are likely all frameshift insertions. All three of the insertions result in premature stop codons within exon 2 (for insertions 1 and 2 a new stop codon occurs at ch16:28943752 and for insertion 3 at ch16:28943887). Table 32 below lists the number of reads supporting the insertion and the wild type as well as associated percentages. The most prevalent insertion is "insertion 3" which is a 4 base insertion and occurs ~30%. Moreover, out of the 15 paired reads which span more than one insertion, none of the paired reads contained more than one insertion, suggesting the insertions are mutually exclusive.

TABLE 32

| Sample | Ins1 (Ins, wt) | Ins2 (Ins, wt) | Ins3 (Ins, wt) |
| --- | --- | --- | --- |
| 29B | 0, 62 | 0, 62 | 0, 50 |
| 29R | 21, 308 | 4, 327 | 67, 151 |
| 104B | 0, 69 | 0, 69 | 0, 79 |
| 104R | 0, 392 | 0, 398 | 0, 413 |
| 105B | 0, 42 | 0, 42 | 0, 63 |
| 105R | 0, 184 | 0, 185 | 0, 212 |

In the Table, "Sample" lists the patient number followed by "B" for baseline sample or "R" for a sample taken upon relapse. The column labeled Ins1 indicates the number of reads showing Ins1 (left number) versus the wild-type sequence at that position (right number); the column labeled Ins2 indicates the number of reads showing Ins2 (left number) versus the wild-type sequence at that position (right number); and labeled Ins3 indicates the number of reads showing Ins3 (left number) versus the wild-type sequence at that position (right number). The Table indicates that only patient 29 showed these three insertions, and the insertions were only observed upon relapse. These results suggest that insertions in exon 2 of CD19 lead to resistance in some patients.

This work identified resistance mechanisms to CTL019 therapy in B-ALL, namely insertions in exon 2 of CD19 by which the tumor cells become CD19− and resistant to CTL019 therapy. This observation provides support for a CTL019 combination strategy with CARs against targets other than CD19, e.g., CD20, CD22, and ROR1.

Example 14: Expression of B-Cell Antigens in Relapsed ALL Cancer Patients

Expression of various B-cell antigens was determined in relapsed acute lymphoblastic leukemia (ALL) cancer patients who had previously been treated with a cancer therapy other than a CAR therapy, i.e., had not been treated with any CAR therapy.

Methods

Samples were obtained as de-identified primary human ALL bone marrow (BM) and peripheral blood (PB) specimens. Anti-human antibodies were purchased from Abcam, Biolegend, Invitrogen, eBioscience, or Becton Dickinson. Mononuclear cells were isolated by Ficoll separation, washed once in PBS supplemented with 2% fetal calf serum, and stained for 15 minutes at room temperature. For cell number quantitation, Countbright (Invitrogen) beads were used according to the manufacturer's instructions. In all analyses, the population of interest was gated based on forward vs. side scatter characteristics followed by singlet gating, and live cells were gated using Live Dead Aqua (Invitrogen). Time gating was included for quality control. For animal studies the murine anti-CD45 antibody (Biolegend) was added to gate out murine leukocytes. Surface expression of CD22 was detected by staining with anti-CD22 monoclonal antibody from clone HIB22 (Biolegend). Surface expression of CD123 was detected by staining with anti-CD123 monoclonal antibody from clone 6H6 (ebioscience). Surface expression of FLT3 was detected by staining with anti-FLT3 monoclonal antibody from clone IM2234U (Beckman Coulter). Surface expression of ROR1 was detected by staining with anti-ROR1 monoclonal antibody from clone 2H6 (Abcam). Surface expression of CD79b was detected by staining with anti-CD79b monoclonal antibody from clone CB3-1 (Biolegend). Surface expression of CD79a was detected by staining with anti-CD79a monoclonal antibody from clone HM47 (R&D Systems). Surface expression of CD10 was detected by staining with anti- CD10 monoclonal antibody from clone eBioCV-CALLA (ebioscience). Surface expression of CD34 was detected by staining with anti-CD34 monoclonal antibody from clone 561 (Biolegend). Surface expression of CD20 was detected by staining with anti-CD20 monoclonal antibody from clone L27 (BD Biosciences). Quantitation of cellular antigen expression in Antibody Binding Capacity (ABC) units was performed using Quantum™ Simply Cellular® (Bangs Lab., Inc) according to standard procedure (http://static.abdserotec.com/uploads/ifu/fcsc815b.pdf). Flow cytometry was performed on a four-laser Fortessa-LSR cytometer (Becton-Dickinson) and analyzed with FlowJo X 10.0.7r2 (Tree Star).

Results

In the relapsed ALL patients, several B-cell antigens were expressed, including CD19, CD22, CD123, FLT-3, CD10, and CD34. See FIG. 22.

Figure 22:
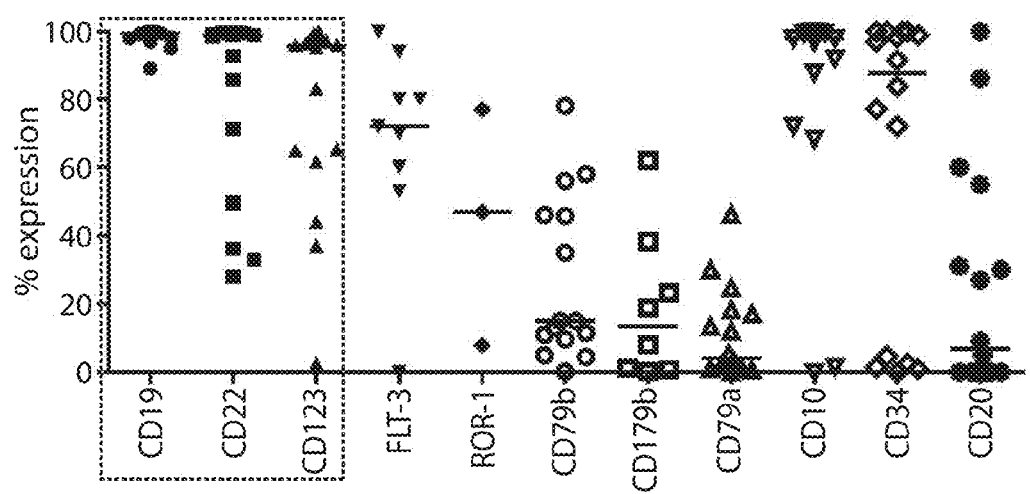
FIG. 22 is a graph depicting the expression of various B-cell antigens in relapsed ALL is a graph depicting the expression of various B-cell antigens in relapsed ALL as detected by flow cytometry. Samples from 16 r/r patients were screened by multiparametric flow cytometry for the following markers: CD19 (16 pts), CD22 (16 pts), CD123 (16 pts), FLT-3 (9 pts), ROR-1 (3 pts), CD79b (15 pts), CD179b (8 pts), CD79a (16 pts), CD10 (16 pts), CD34 (16 pts), and CD20 (16 pts). CD22 and CD123 were highly (>60%) and homogeneously expressed in the blasts of r/r ALL patients (bar indicates median % expression, respectively 99.50%, 98.80%, 95.70%, 72.00%, 47.00%, 15.00%, 13.45%, 4.200%, 98.00%, 87.65%, and 7.00%). For each patient, the percentage of cells expressing the marker indicated is shown as a single data point.

In order to identify potential additional B-cell acute lymphoblastic leukemia (B-ALL) targets, samples from 16 r/r patients were screened by multiparametric flow cytometry for the following markers: CD19 (16 pts), CD22 (16 pts), CD123 (16 pts), FLT-3 (9 pts), ROR-1 (3 pts), CD79b (15 pts), CD179b (8 pts), CD79a (16 pts), CD10 (16 pts), CD34 (16 pts), and CD20 (16 pts). CD22 and CD123 were highly (>60%) and homogeneously expressed in the blasts of r/r ALL patients (bar indicates median % expression, respectively 99.50%, 98.80%, 95.70%, 72.00%, 47.00%, 15.00%, 13.45%, 4.200%, 98.00%, 87.65%, and 7.00%). (FIG. 22).

Figure 23:
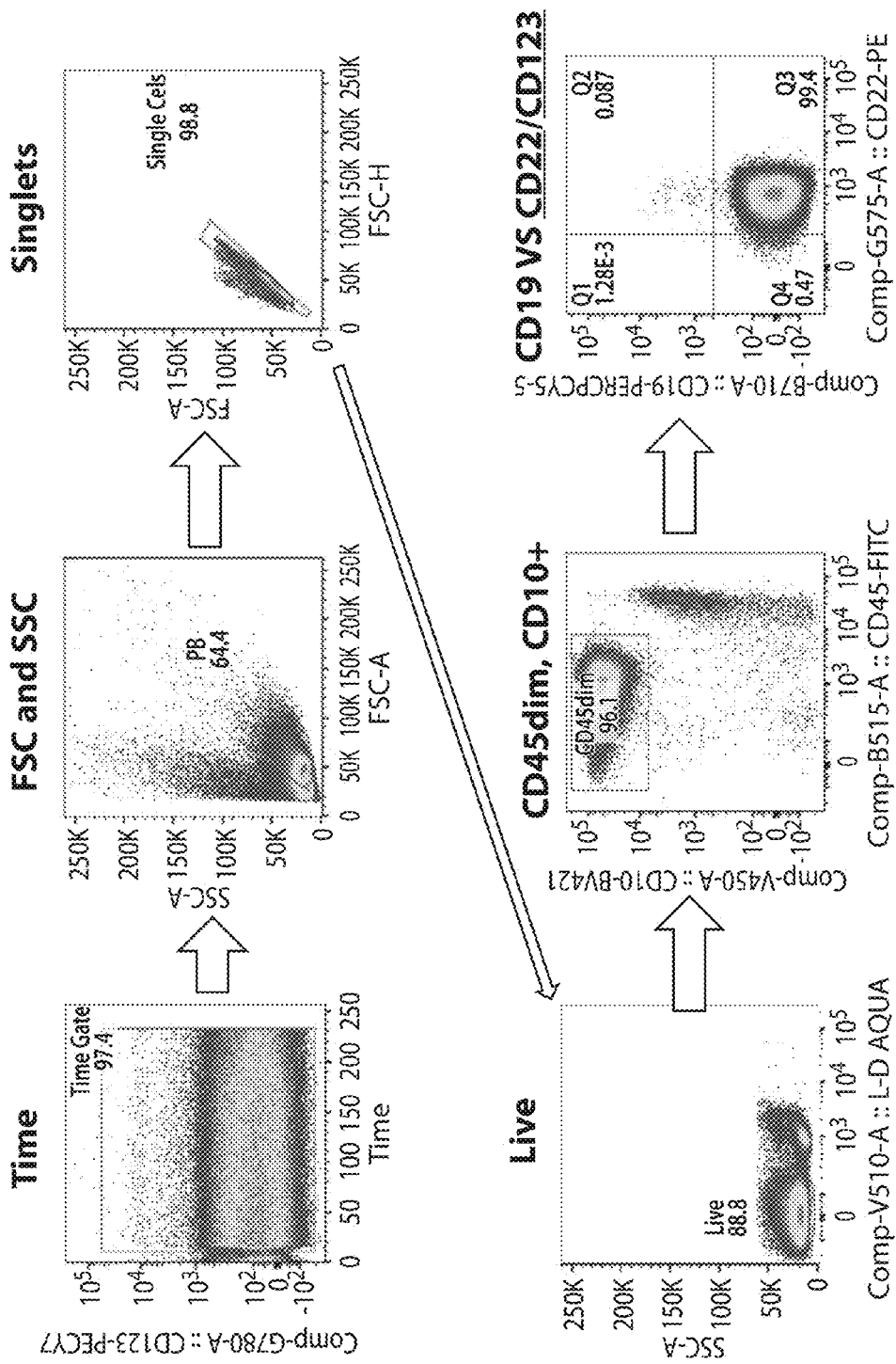
FIG. 23 is a set of graphs showing is a set of graphs showing expression of CD22 and CD123 in 6 patients relapsing with CD19-negative leukemia, both before CART19 treatment (baseline) and after (CD19-neg relapse). In all analyses, the population of interest was gated based on forward vs. side scatter characteristics followed by singlet gating, and live cells were gated using Live Dead Aqua (Invitrogen). Time gating was included for quality control. The gating strategy included: time gating→SSC low→singlets→live→CD45dim→CD10+.

Example 15: Expression of B-Cell Antigens in Relapsed CD19-Negative Cancer Patients Expression of various B-cell antigens was determined in patients who had previously been treated with a CD19 CAR and who have relapsed with CD19-negative tumors. Flow cytometry was used according to the methods in Example 14 to determine expression of the antigens, with a gating strategy depicted in FIG. 23.

Expression of CD22 and CD123 was analyzed in BM and PB samples from 6 patients relapsing with CD19-negative leukemia, both before CART19 treatment (baseline) and after (CD19-negative relapse). In all analyses, the population of interest was gated based on forward vs. side scatter characteristics followed by singlet gating, and live cells were gated using Live Dead Aqua (Invitrogen). Time gating was included for quality control. The gating strategy included: time gating→SSC low→singlets→live→CD45dim 4 CD10+.

Results

Figure 24:
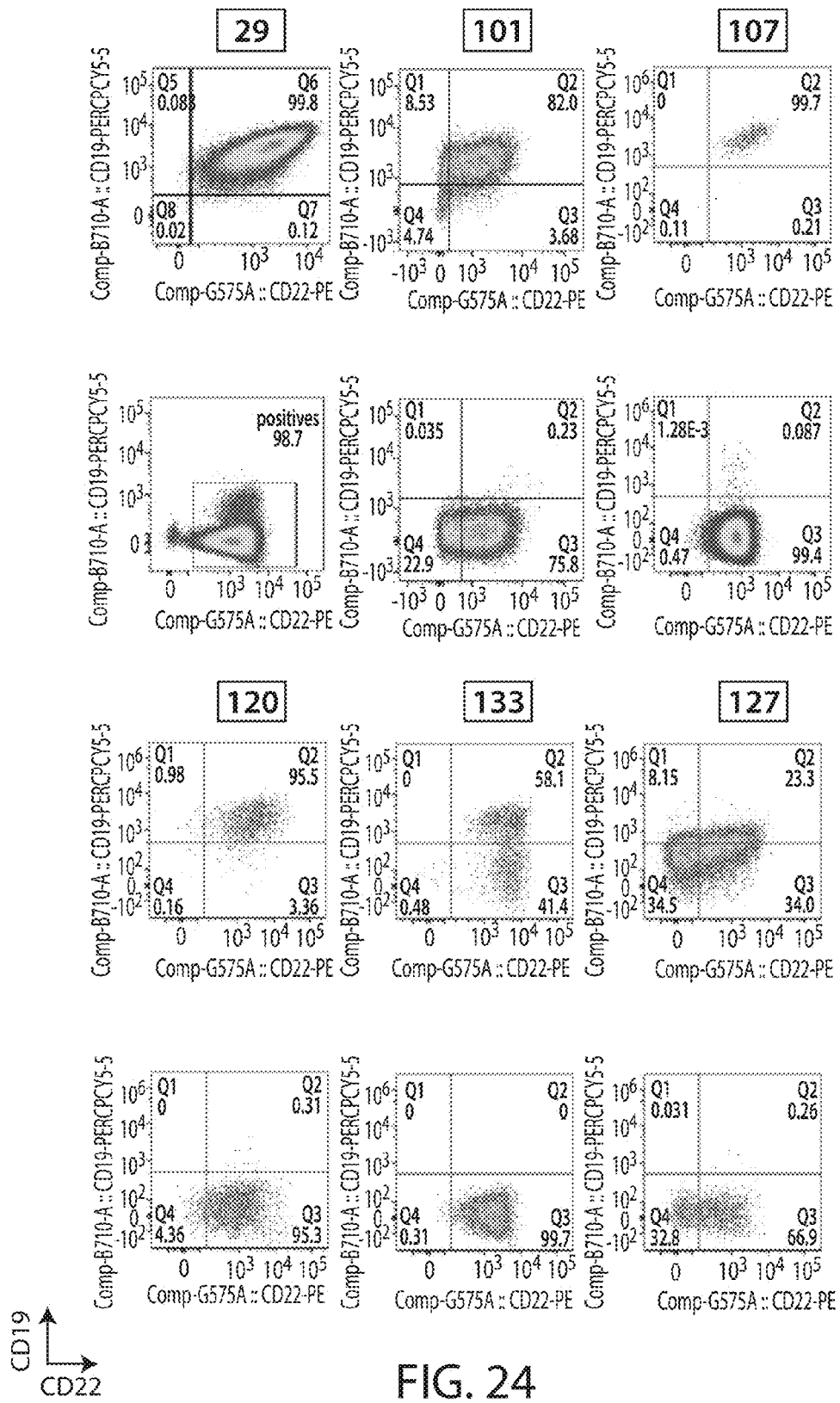
FIG. 24 is a set of graphs showing the expression of CD22 in blasts from patient relapsing with CD19-neg disease after CART19 treatment (clinical trials UPCC04409/CHP959, patient UPN indicated in the squared box). The top row shows the CD19 and CD22 expression in blasts before CART19 treatment while the bottom row shows the disease phenotype at relapse. CD22 expression was maintained also at relapse when CD19 expression was lost.
Figure 25:
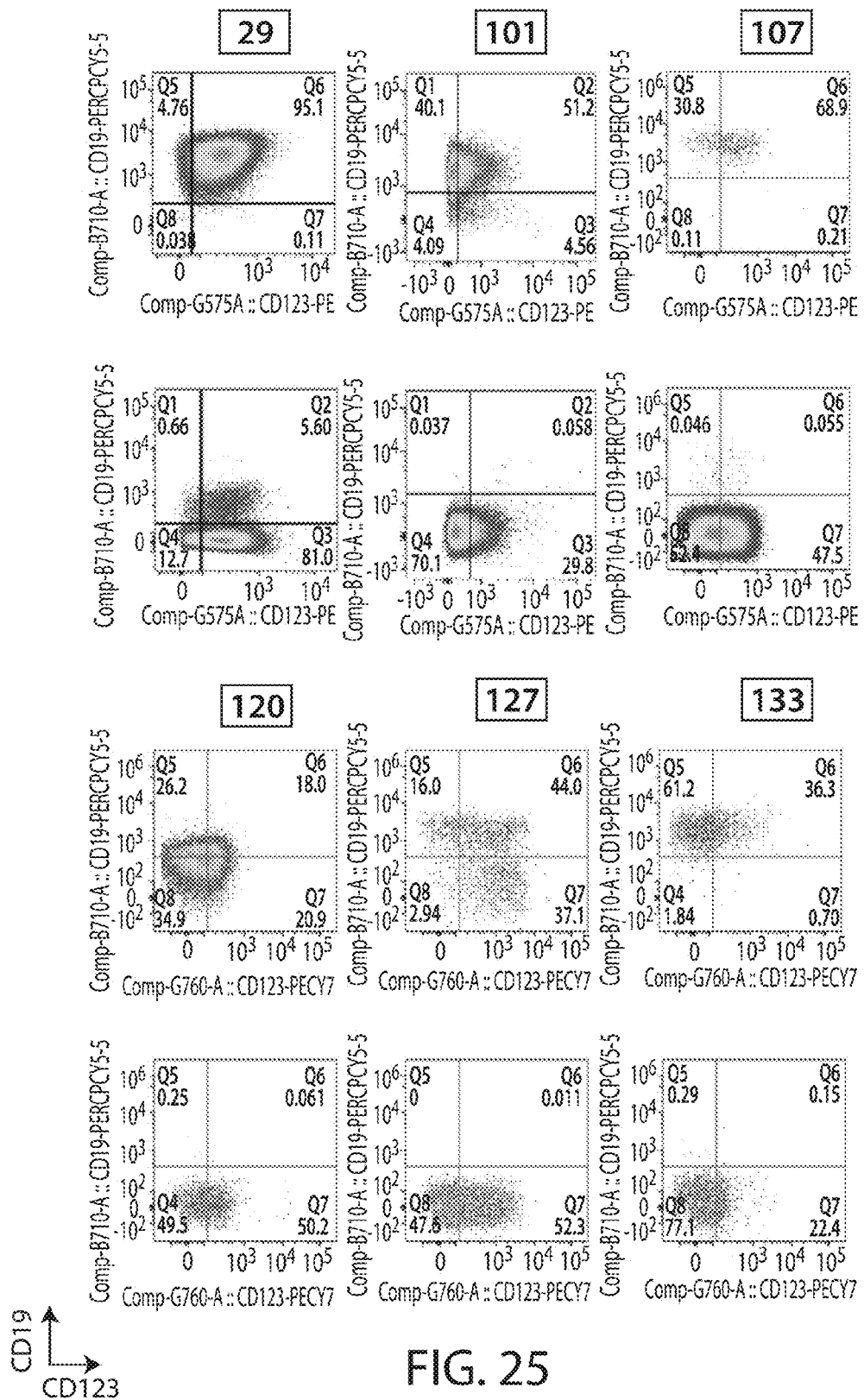
FIG. 25 is a set of graphs showing the expression of CD123 in is a set of graphs showing expression of CD123 in blasts from patient relapsing with CD19-neg disease after CART19 treatment (clinical trials UPCC04409/CHP959, patient UPN indicated in the squared box). The top row shows the CD19 and CD123 expression in blasts before CART19 treatment while the bottom row shows the disease phenotype at relapse. CD123 expression was maintained at relapse in most of the patients while CD19 expression was lost.
Figure 26:
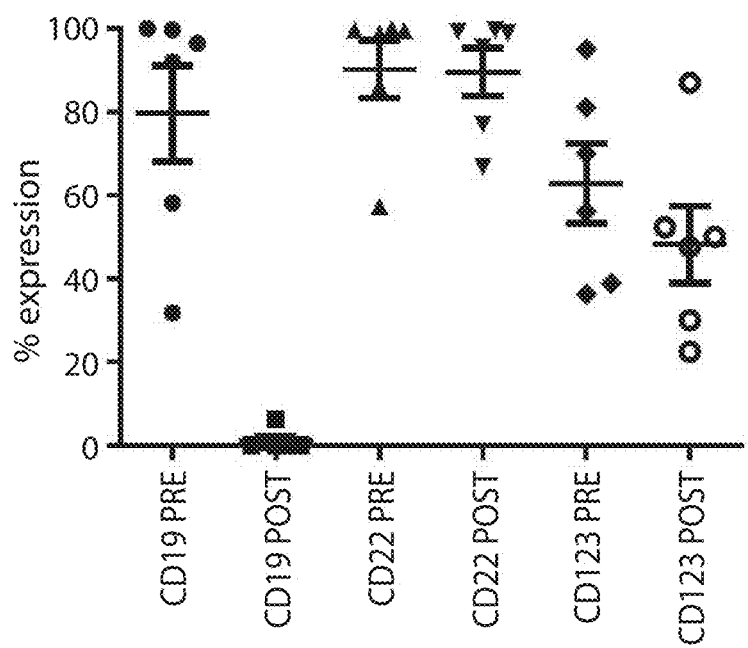
FIG. 26 is a graph showing the median expression of CD19, CD22 and CD123 before and after CART19 treatment in patients relapsing with a CD19-negative disease. CD19 expression was lost at relapse (94.25% vs. 0%, p=0.0009), while CD22 (99.20% vs. 97.30%, p=ns) and CD123 (63.00% vs. 48.75%, p=ns) were still expressed. For each patient, the percentage of cells expressing the marker indicated is shown as a single data point.

Almost all patients who became CD19-negative remained both CD22-positive and CD-123-positive. See FIG. 24 and FIG. 25. The results are summarized in FIG. 26, and demonstrate that while CD19 CART treatment results in a loss of CD19 expression (as measured by flow cytometry), CD22 and CD123 expression remains high.

Example 16: Expanded Access Treatment with Autologous CD22 Redirected CART Cells in Refractory B-Cell Malignancies Relapsing/refractory (r/r) B-cell Acute Lymphoblastic Leukemia (ALL) is associated with a poor prognosis in both pediatric and adult patients. Novel therapies targeting CD19 on leukemic blasts, such as anti-CD19 Chimeric Antigen Receptor T cells (CART19, CTL019) or bi-specific anti-CD19/CD3 antibodies (blinatumomab) induce significant responses in this population. However, CD19-negative relapses have been reported in 5-10% of patients following CART19 or blinatumomab therapies.

Methods

Cell Line and Primary Samples

Cells of the ALL cell line, NALM-6, were maintained in culture with RPMI media supplemented with 10% fetal calf serum, penicillin, and streptomycin. For some experiments, NALM-6 cells were transduced with luciferase/GFP+ and then sorted to obtain a >99% positive population. The acute myeloid leukemia cell lines MOLM-14 or K562 and the T-ALL cell line JURKAT were used as CD22-negative controls.

De-identified primary human ALL bone marrow (BM) and peripheral blood (PB) specimens and BM and PB samples from two patients relapsing after CART-19 therapy were obtained. ALL blasts from patient treated with CART-19 and relapsed with CD19-negative leukemia were collected at baseline (1R82, prior to CART19 therapy) and relapse (1R243). Primary blasts from these 2 time points were expanded in vivo in NSG mice and transduced with luciferase/GFP after several passages (Barrett, D et al. (2011) Blood 118(15):e112-117). For all functional studies, ALL cells were thawed at least 12 hours before analysis and rested at 37° C.

Generation of CAR Constructs and CAR T Cells

A chimeric antigen receptor (CAR) against CD22 was generated using the anti-CD22 single-chain variable fragment light (L) and heavy (H) chain sequences described in U.S. Patent Application No. 2011/0020344 A1, which describes generation of an anti-CD22 fully human monoclonal antibody m971 (Xiao, X et al. (2009) MAbs. 1(3): 297-303). The sequences were codon-optimized and two different CAR constructs were generated using two different variable chain orientations (H to L and L to H). These two anti-CD22 scFvs were then cloned into a murine CAR19 backbone (CD8 hinge, 41BB costimulatory domain and CD3 zeta signaling domain) and subsequently in the pTRPE lentiviral vector. Murine CAR19 was generated as previously described (Milone, M et al. (2009) Molecular therapy: the journal of the American Society of Gene Therapy 17(8):1453-1464).

Production of CAR-positive T-cells was performed as previously described (Gill, S et al. (2014) Blood 123(15): 2343-2354). Normal donor CD4-positive and CD8-positive T cells were plated at the concentration of 1e6/ml, with a CD4:CD8 ratio of 1:1 and expanded in X-vivo 15 media (Lonza, 04-418Q), human serum AB 5% (Gemini, 100-512), penicillin/streptomycin (Gibco, 15070063) and Glutamax (Gibco, 35050061) using anti-CD3/CD28 Dynabeads (Life Technologies, 11161D) added on the day 1 of culture and removed on day 6. T-cells were transduced with lentivirus carrying either CAR22, CAR19 or mock transfected on day 2. T-cells were expanded in culture for 10-15 days and harvested when the median cell volume was below 300 fl. T-cells were then cryopreserved in FBS 10% DMSO for future experiments. Prior to all experiments, T-cells were thawed and rested overnight at 37° C.

Multiparametric Flow Cytometry Analysis

Anti-human antibodies were purchased from Biolegend, eBioscience, or Becton Dickinson. Cells were isolated from in vitro culture or from animals, washed once in PBS supplemented with 2% fetal calf serum, and stained for 15 minutes at room temperature. For cell number quantitation, Countbright (Invitrogen) beads were used according to the manufacturer's instructions. In all analyses, the population of interest was gated based on forward vs. side scatter characteristics followed by singlet gating, and live cells were gated using Live Dead Aqua (Invitrogen). Time gating was included for quality control. For animal studies the murine anti-CD45 antibody (Biolegend) was added to gate out murine leukocytes. Surface expression of anti-CD22 CAR was detected by staining with CD22-His protein (11958-H08H-50) and anti-His-APC monoclonal antibody (IC050A). CAR19 was detected as previously described (Kalos, M et al. (2011) Science translational medicine 3(95):95ra73). Quantitation of CD19 and CD22 cellular antigen expression in Antibody Binding Capacity (ABC) units was performed on NALM-6 and controls using Quantum™ Simply Cellular® (Bangs Lab., Inc) according to standard procedure (http://static.abdserotec.com/uploads/ifu/fcsc815b.pdf). Flow cytometry was performed on a four-laser Fortessa-LSR cytometer (Becton-Dickinson) and analyzed with FlowJo X 10.0.7r2 (Tree Star).

Degranulation Assay

Degranulation assays were performed as previously described. T-cells were incubated with target cells at a 1:5 ratio in T cell media. Anti-CD107a-PECY7 (Biolengend), anti-CD28 (BD Biosciences), anti-CD49d (BD Biosciences) antibodies and monensin (BD Biosciences) were added to co-culture 30 minutes after starting time. After 4 hours, cells were harvested and stained for CAR expression, CD3, CD8 and Live Dead aqua staining (Invitrogen). Cells were fixed and permeabilized (Invitrogen Fix/Perm buffers) and intracellular staining was then performed to detect multiple cytokines (IFN, TNFa, IL-2, GM-CSF, MIP1b).

Proliferation Assay

T cells were washed and resuspended at 1×107/ml in 100 µl of PBS and stained with 100 µl of CFSE 2.5 µM (Invitrogen) for 5 minutes at 37° C. The reaction was then quenched with cold media, and cells were washed three times. Targets were irradiated at a dose of 100 Gy. T-cells were incubated at a 1:1 ratio with irradiated target cells for 120 hours, adding media at 24 hours. Cells were then harvested, stained for CD3, CAR and Live Dead aqua (Invitrogen), and Countbright beads (Invitrogen) were added prior to flow cytometric analysis for absolute quantification.

Cytotoxicity Assays

Luciferase/GFP+ NALM-6 cells or primary ALL samples were used for cytotoxicity assay as previously described. 4 Targets were incubated at the indicated ratios with effector T-cells for 4 or 16 hours. Killing was calculated either by bioluminescence imaging on a Xenogen IVIS-200 Spectrum camera or by flow cytometry. For the latter, cells were harvested and Countbright beads and 7-AAD (Invitrogen) were added prior to analysis. Residual live target cells were CFSE-positive 7-AAD-negative.

Cytokine Measurements

Effector and target cells were co-incubated at a 1:1 ratio in T-cell media for 24 hours. Supernatant was harvested and analyzed by 30-plex Luminex array (Luminex Corp, FLEX-MAP 3D) according to the manufacturer's protocol (Invitrogen) (Kalos, M et al. (2011)).

In Vivo Experiments

NOD-SCID-γ chain−/− (NSG) mice were obtained. All experiments were performed on protocols approved by the Institutional Animal Care and Use Committee (IACUC) of the University of Pennsylvania. Schemas of the utilized xenograft models are discussed in details in the results section. Cells (NALM-6 or T cells) were injected in 200 ul of PBS at the indicated concentration into the tail veins of mice. Bioluminescent imaging was performed using a Xenogen IVIS-200 Spectrum camera and analyzed with LivingImage software v. 4.3.1 (Caliper LifeSciences). Animals were euthanized at the end of the experiment or when needed according to IACUC policies.

Immunohistochemistry

Tissue microarrays (TMA) of 28 human normal tissues (adipose, adrenal, appendix, cerebellum, cervix, colon, endometrium, esophagus, fat, heart, kidney, liver, lymph node, lung, muscle, ovary, pancreas, parathyroid, placenta, prostate, salivary, spinal, spleen, stomach, testis, thymus, thyroid, tonsil) were performed in order to evaluate off-tumor expression of CD22 (triplicates). Immuno-histochemical (IHC) staining of formalin fixed paraffin embedded tissues was performed on a Leica Bond-III instrument using the Bond Polymer Refine Detection System. Antibodies against CD22 (Clone FPC1; Leica PA0249) were used undiluted. Heat-induced epitope retrieval was done for 20 minutes with ER2 solution (Leica Microsystems AR9640). Images were digitally acquired using the Aperio ScanScope™.

Gene Expression Profiling.

Publicly accessible RNA-expression database (GeneAtlas U133A, gc) was analyzed using BioGPS.org website for CD22 expression. Median CD22 RNA expression was reported for 75 different human normal cell types and 7 tumor cell lines (see FIGS. 39A, 39B, 39C and 39D).

51-Chromium-Release Assay

In order to evaluate to possible off-tumor CART22 toxicity, Chromium-release assay was performed, using as a target normal human tissues (CD34+, human neurons, human neuronal progenitors, keratinocytes) and K562 or NALM-6 as controls. Target cells were incubated with 51Cr 50 µCi/0.5e6 cells for 1-2 hrs at 37° C. Cells were washed and plated in triplicate with effectors cells at different E:T ratios. After 4 hour-incubation, an aliquot from each well was put in a reader plate and dried overnight. The next day chromium release was quantified using 1450 Microbeta Plus Liquid Scintillation Counter.

Results

TABLE 33

Summary of the donors and the respective experiments performed for CART22 evaluation.

| Donors | Expansion | Degran. + i.c. cytokines | Prolif. + Luminex | Killing | In vivo | Tox Screen |
|---|---|---|---|---|---|---|
| 1 | ✓ | ✓ X2 | ✓ X2 | ✓ X2 | ✓ | |
| 2 | ✓ | ✓ | | | | |
| 3 | ✓ | | | | ✓ | ✓ |
| 4 | ✓ | | | | | |
| 5 | ✓ | | | | ✓ | |

Figure 27A:
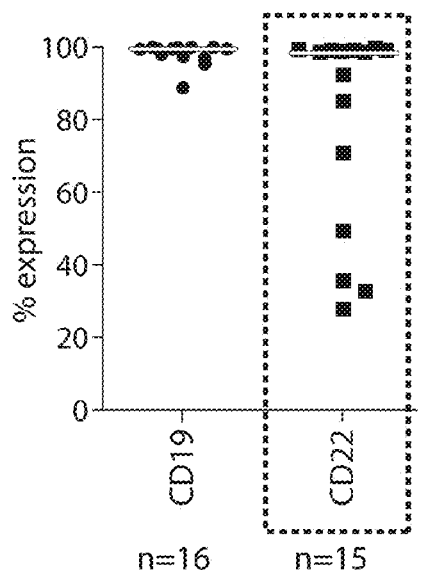
FIGS. 27A and 27B are a series of graphs showing CD22 expression in samples from 16 r/r patients and 4 patients relapsing with CD19-negative disease after treatment with CART19 therapy. Samples were screened by multiparametric flow cytometry for the B cell marker, CD22. CD22 was highly (>60%) and homogeneously expressed in the blasts of 11/15 r/r ALL patients (FIG. 27A). CD22 was positive in 4/4 patients relapsing with CD19-negative leukemia, both before CART19 treatment (baseline) and after (CD19-neg relapse) (2 pts shown) (FIG. 27B). Gating strategy: SSC low÷singlets→live→CD45dim.
Figure 27B:
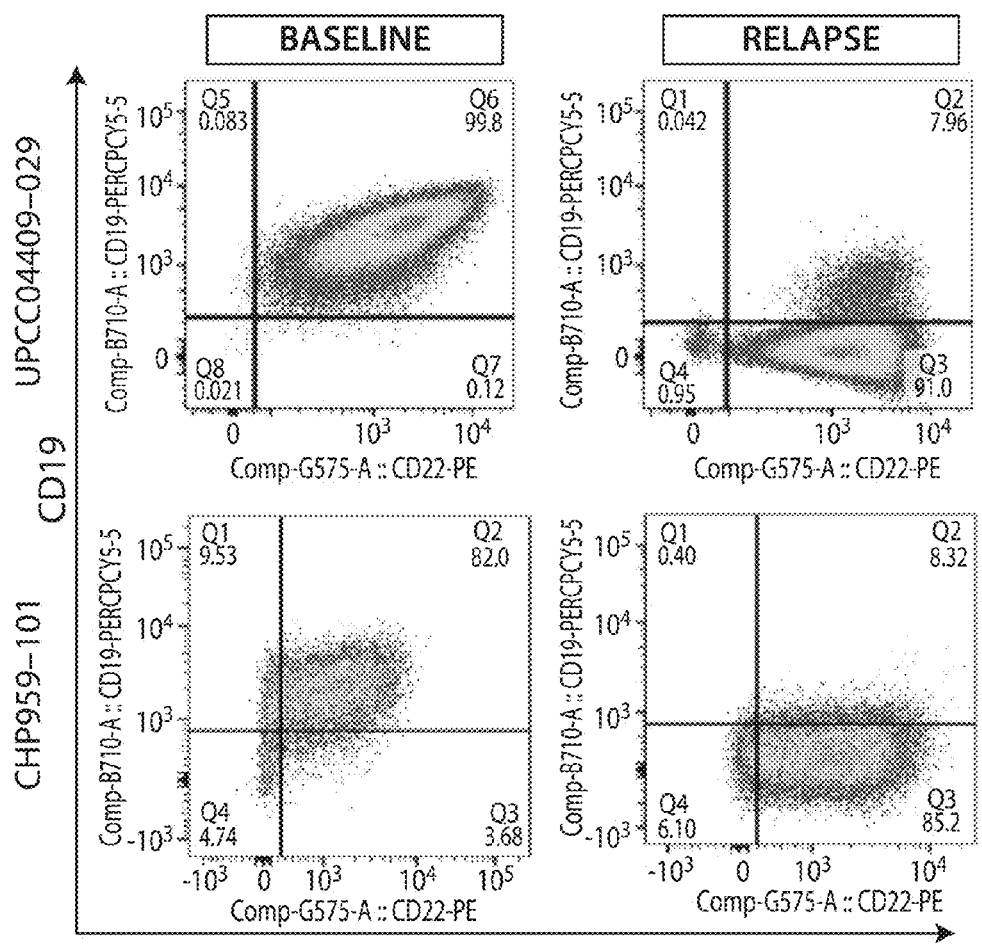

In order to identify potential B-ALL targets, samples from 16 r/r patients and 4 patients relapsing with CD19-negative disease after treatment with CART19 therapy were screened by multiparametric flow cytometry for the B cell marker, CD22. CD22 was highly (>60%) and homogeneously expressed in the blasts of 11/15 r/r ALL patients (FIG. 27A). CD22 was also positive in 4/4 patients relapsing with CD19-negative leukemia, both before CART19 treatment (baseline) and after (CD19-neg relapse) (2 pts shown) (FIG. 27B). (Gating strategy: SSC low→singlets→live→CD45dim).

Figure 28A:
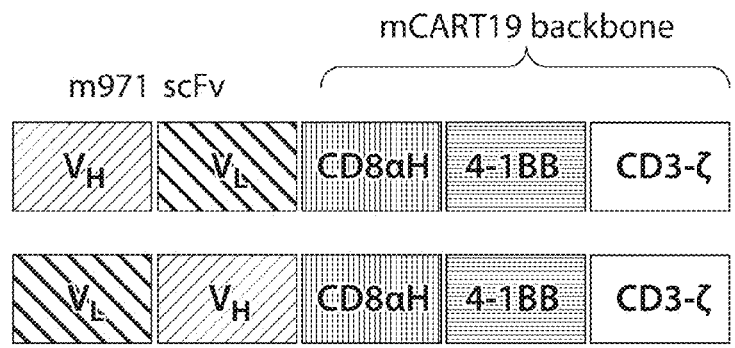
FIGS. 28A, 28B, and 28C are a series of graphs showing the effect of CD22 CART on CD19 and CD22 expression. Schema of the two CAR22 constructs that were generated using different chain orientations (H to L and L to H) is shown (FIG. 28A). The anti-CD22 scFv (m971) was codon optimized and cloned in the murine CAR19 vector containing CD8 hinge, 41-BB costimulatory and CD3 zeta signaling domains (FIG. 28A). The expression of CD19, CD22 and isotype control on NALM6 ALL cell line is shown as mean fluorescence intensity (MFI) (FIG. 28B) and antibody-binding capacity (ABC) (FIG. 28C). In NALM-6 the expression of CD19 was higher than CD22. However, in most primary ALL samples the CD19 and CD22 expressions were similar (see FIG. 27A).
Figure 28B:
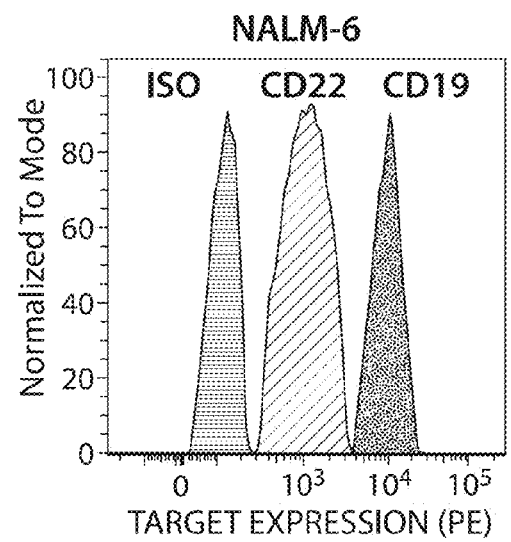
Figure 28C:
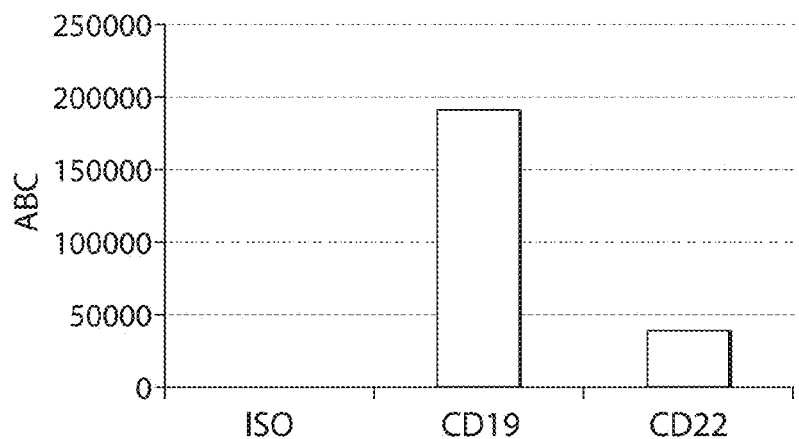

The schema of the CAR22 constructs that were generated using different chain orientations (H to L and L to H) is shown in FIG. 28A. The anti-CD22 scFv (m971) was codon optimized and cloned in the murine CAR19 vector containing CD8 hinge, 41-BB costimulatory and CD3 zeta signaling domains. The expression of CD19, CD22 and isotype control on NALM6 ALL cell line is shown as mean fluorescence intensity (MFI) (FIG. 28B) and antibody-binding capacity (ABC) (FIG. 28C). The results presented herein demonstrate that in NALM-6 cells, the expression of CD19 is higher than CD22. However, in most primary ALL samples, the CD19 and CD22 expressions are similar (see FIG. 28A).

Figure 29A:
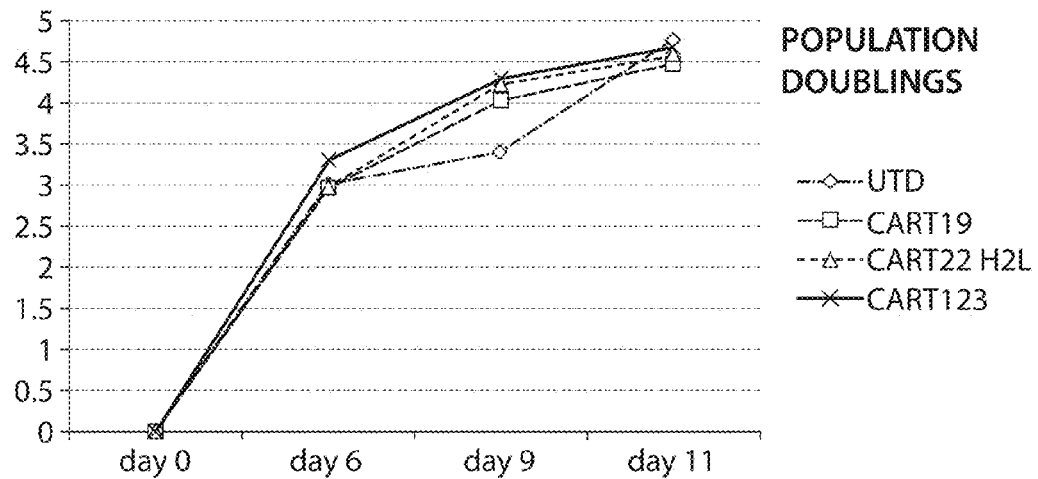
FIGS. 29A, 29B, and 29C are a series of graphs showing normal donor T cell expansions for generating CART22 and CART19 (together with UTD cells). Population doublings (PD) versus days in culture: at the end of the expansion (day 11) CART22 and control T cells reached around 4.5 PD, with no significant difference in comparison to CART19 or UTD cells (FIG. 29A). T cell volume (fl) versus days in culture: at day 6 there was peak volume (around 450 fl) while in the following days the volume decreased down to 300 fl when the cells are harvested and frozen. No significant different was observed versus CART19 or UTD cells (FIG. 29B). CAR expression on CD4-positive and CD8-positive T-cells at day 11 of expansion is shown in FIG. 29C. Gating for CAR expression is based on UTD. Gating strategy: FSS vs SSC lymphocytes→singlets→live→CD3+.
Figure 29B:
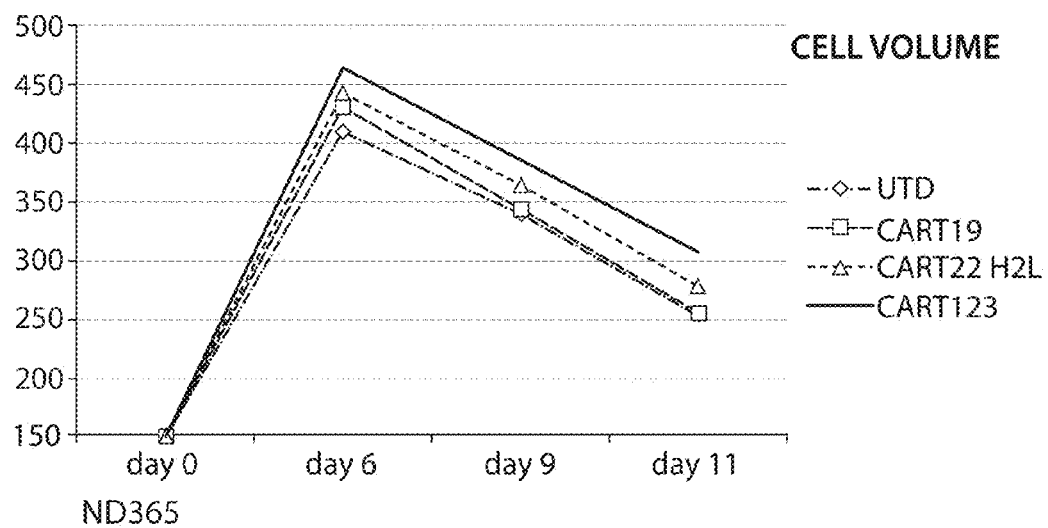
Figure 29C:
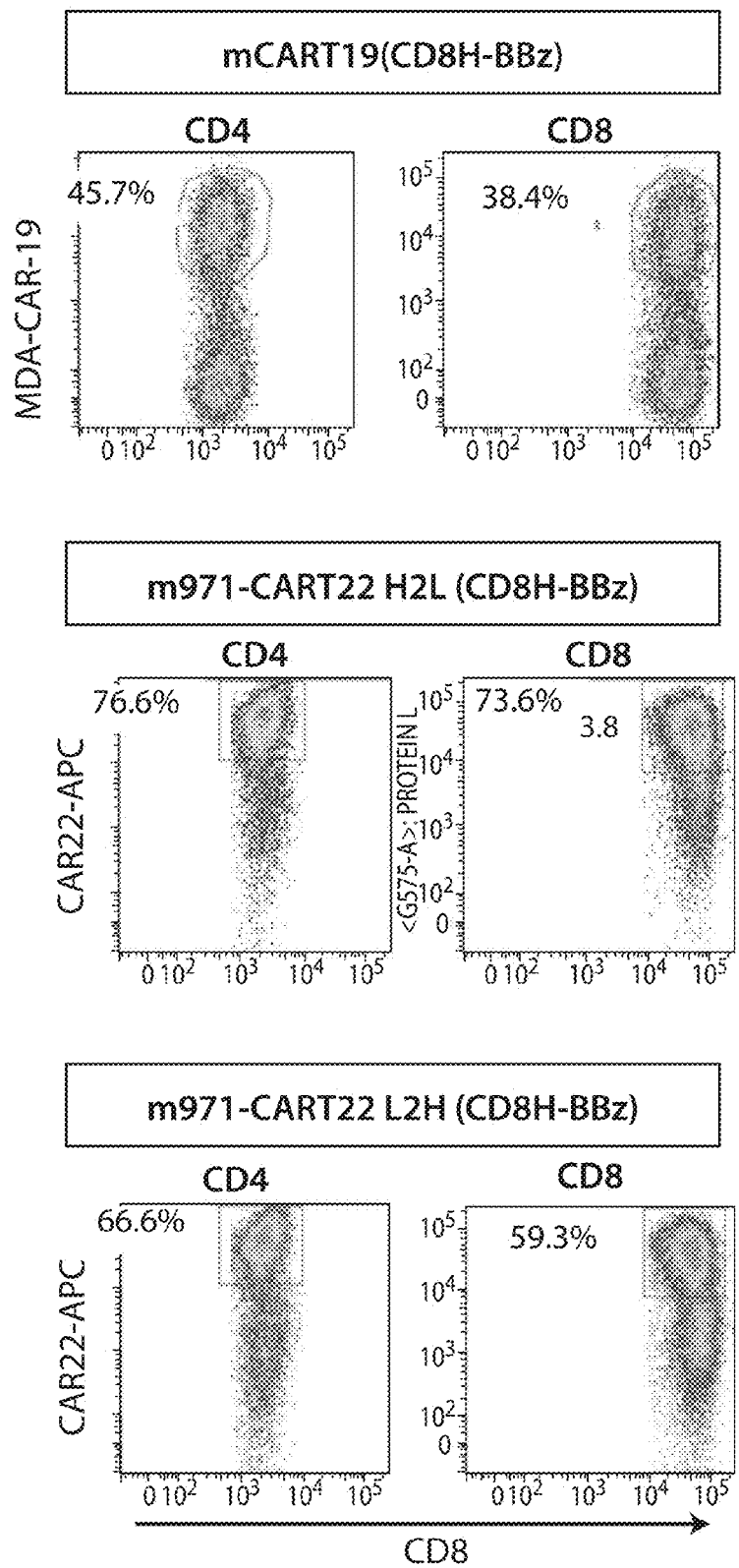

Normal donor T-cell expansions for generating CART22 and CART19 (together with untransduced cells (UTD)) were carried out. Population doubling times and T-cell volume were measured relative to days in culture. At the end of the expansion (day 11 in culture) CART22 and control T-cells reached around 4.5 population doublings (PD), with no significant difference in comparison to CART19 or UTD cells (FIG. 29A). At day 6 in culture the peak volume was around 450 fl, while in the following days the volume decreased down to 300 fl when the cells were harvested and frozen (FIG. 29B). No significant different was observed versus CART19 or UTD. CAR expression on CD4-positive and CD8-positive T cells was observed at day 11 of expansion by flow cytometry (FIG. 29C). Gating for CAR expression is based on UTD. (Gating strategy: FSS vs SSC lymphocytes→singlets→live→CD3+).

Figure 30:
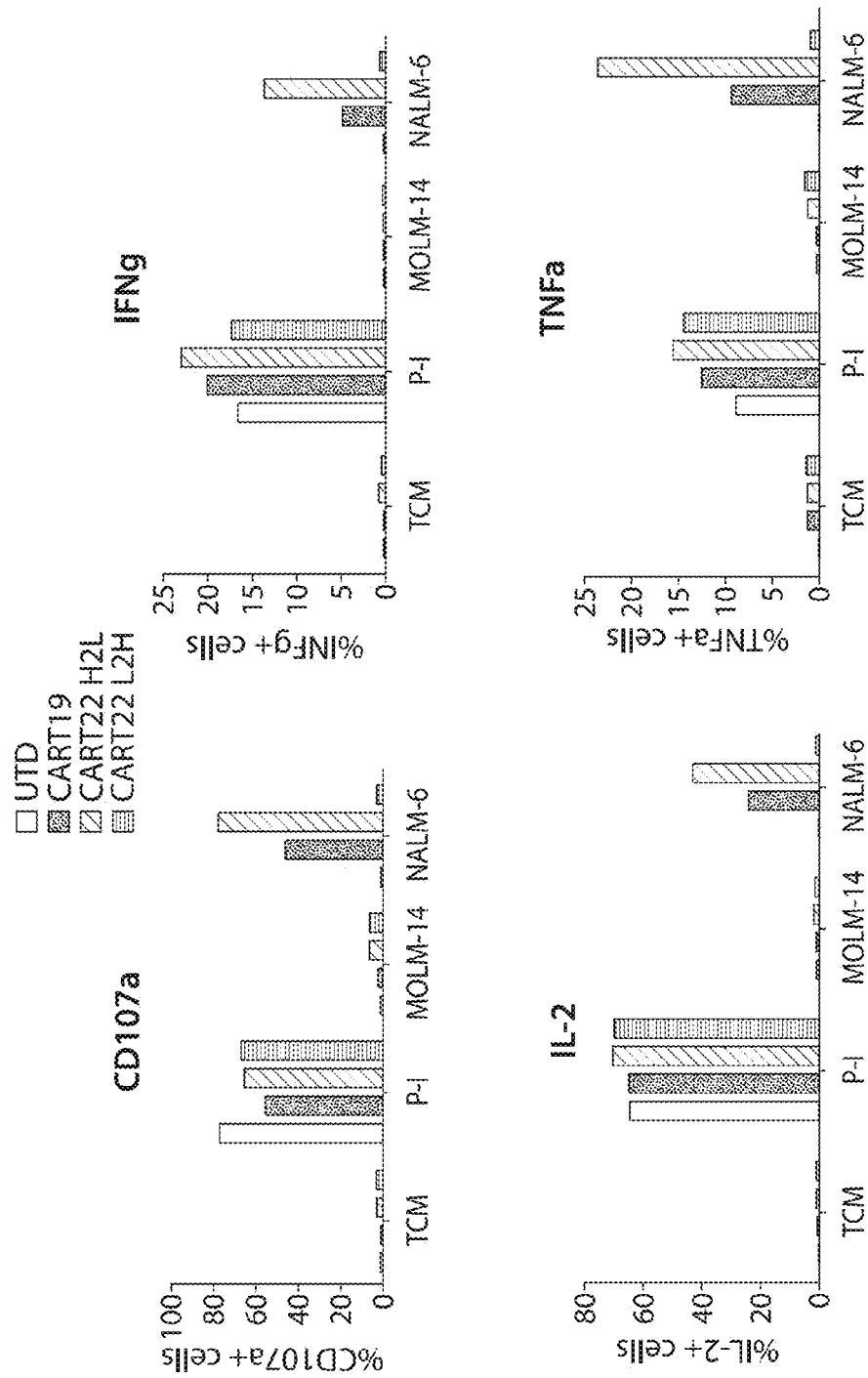
FIG. 30 is a series of graphs showing a CD107a degranulation assay with intra-cytoplasmic cytokine production. CART19, CART22 HtoL and LtoH were co-cultured with different targets (alone, PMA/IONOMYCIN, MOLM-14 and NALM-6). CART19 and CART22 HtoL show high levels of CD107a degranulation, IL-2, IFNg and TNFa production when co-cultured with the ALL cell line (NALM-6) but not when co-cultured with negative controls. UTD and CART22 LtoH did not show degranulation nor cytokine productions. Gating strategy: FSS vs SSC lymphocytes→singlets→live→CD3+.

CD107a degranulation assay with intra-cytoplasmic cytokine production was carried out. CART19, CART22 HtoL and LtoH were co-cultured with different targets (alone, PMA/IONOMYCIN, MOLM-14 and NALM-6). CART19 and CART22 HtoL showed high levels of CD107a degranulation, IL-2, IFNg and TNFa production when co-cultured with the ALL cell line (NALM-6) but not when co-cultured with negative controls (FIG. 30). UTD and CART22 LtoH do not show degranulation nor cytokine productions (FIG. 30). (Gating strategy: FSS vs SSC lymphocytes→singlets→live→CD3+).

Figure 31:
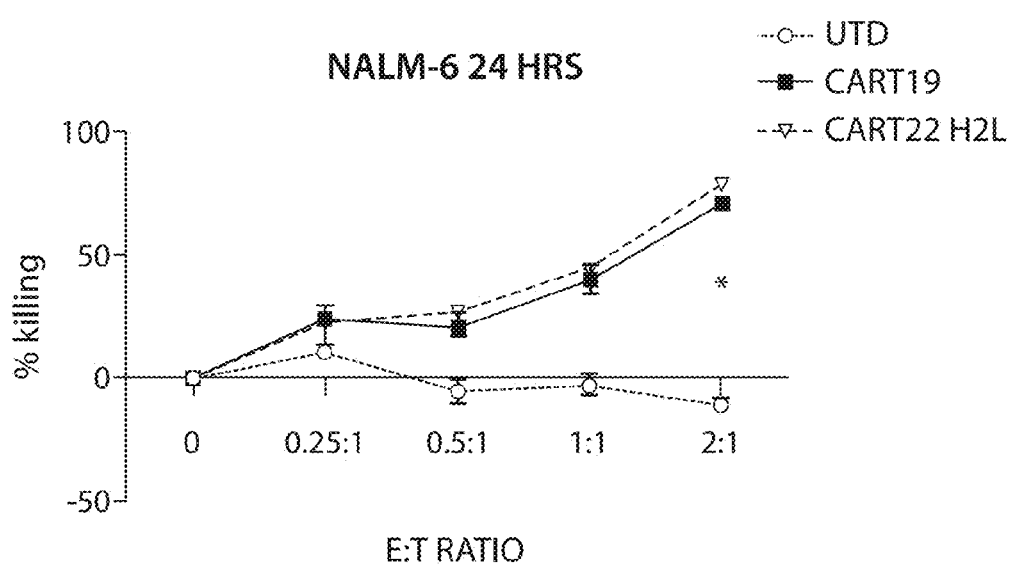
FIG. 31 is a graph showing a luciferase-based killing assay. CART22 and CART19 HtoL but not UTD cells were able to lyse NALM-6 cells when co-cultured os for 24 hours. A direct correlation between cytotoxic activity and E:T ratios was observed, with better anti-leukemia effect at 2:1 E:T ratio (78% and 75% killing for CART19 and CART22).

In a luciferase-based killing assay, CART22 and CART19 HtoL but not UTD were able to lyse NALM-6 cells when co-cultured for 24 hours (FIG. 31). A direct correlation between cytotoxic activity and E:T ratios was observed, with better anti-leukemia effect at 2:1 E:T ratio (78% and 75% killing for CART19 and CART22).

In a CFSE-based proliferation assay, co-culture for 5 days of CART22 and CART19 with the ALL cell line NALM-6 led to significant T cell proliferation (94% and 92.9% respectively). Controls are also shown (TCM=media alone, P-I=PMA/Ionomycin, MOLM-14) (FIG. 32A) Histograms showing the dynamics of CFSE dilution in CART19 and CART22 demonstrate that most T-cells underwent multiple proliferative cycles (FIG. 32B). (Gating strategy: FSS vs SSC lymphocytes→singlets→live→CD3+)

Figure 33:
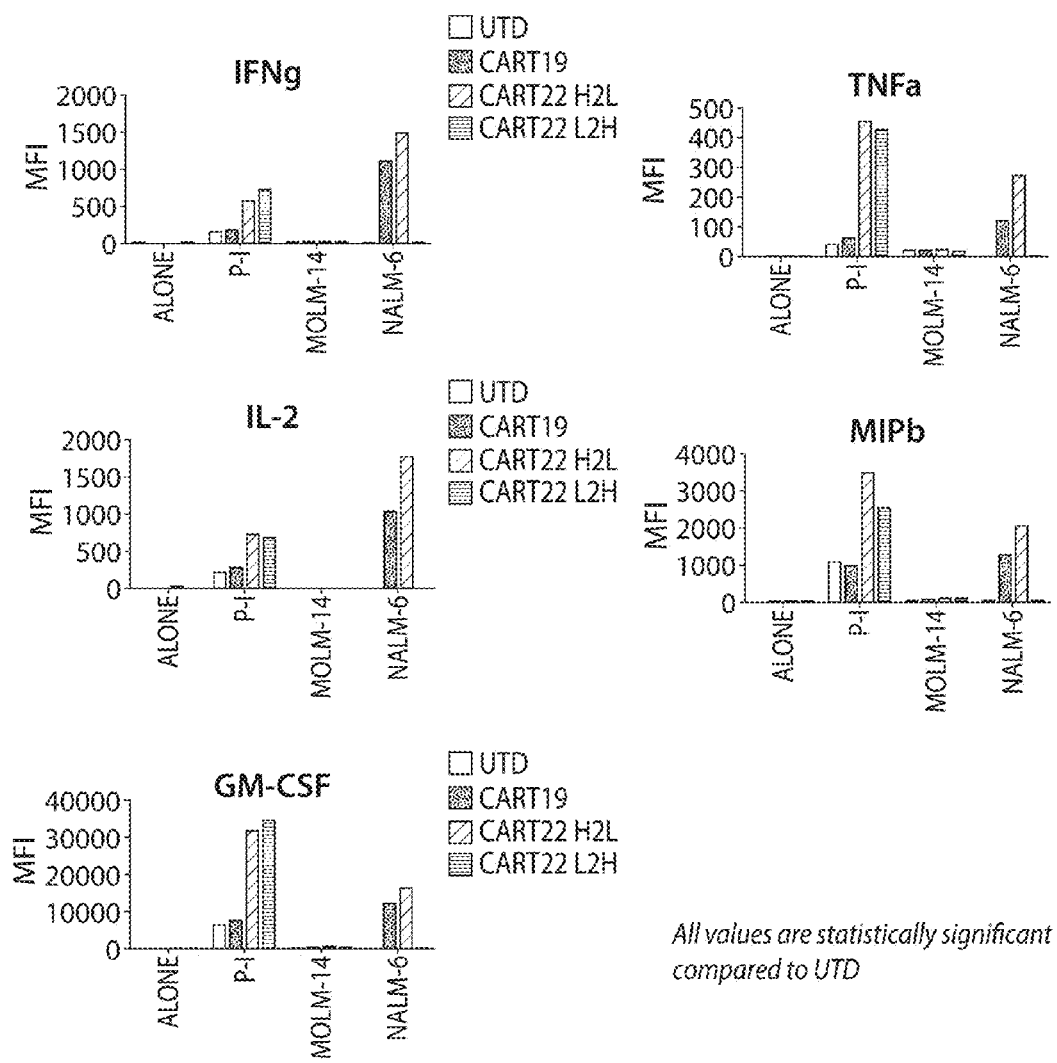
FIG. 33 is a series of graphs showing cytokine production. CART22, CART19 and UTD were incubated for 24 hours with different irradiated targets (alone, PMA/Ionomycin, MOLM-14 and NALM-6). When co-cultured with the ALL cell line NALM-6 only CART22 and CART19 HtoL were able to release multiple cytokines (here shown IFNg, IL-2, GM-CSF, TNFa and MIP1b). Results are shown as mean intensity fluorescence (MFI).

CART22, CART19 and UTD cells were incubated for 24 hours with different irradiated targets (alone, PMA/Ionomycin, MOLM-14 and NALM-6). When co-cultured with the ALL cell line NALM-6, only CART22 and CART19 HtoL were able to release multiple cytokines (here shown IFNg, IL-2, GM-CSF, TNFa and MIP1b) (FIG. 33).

Figures 34A, 34B:
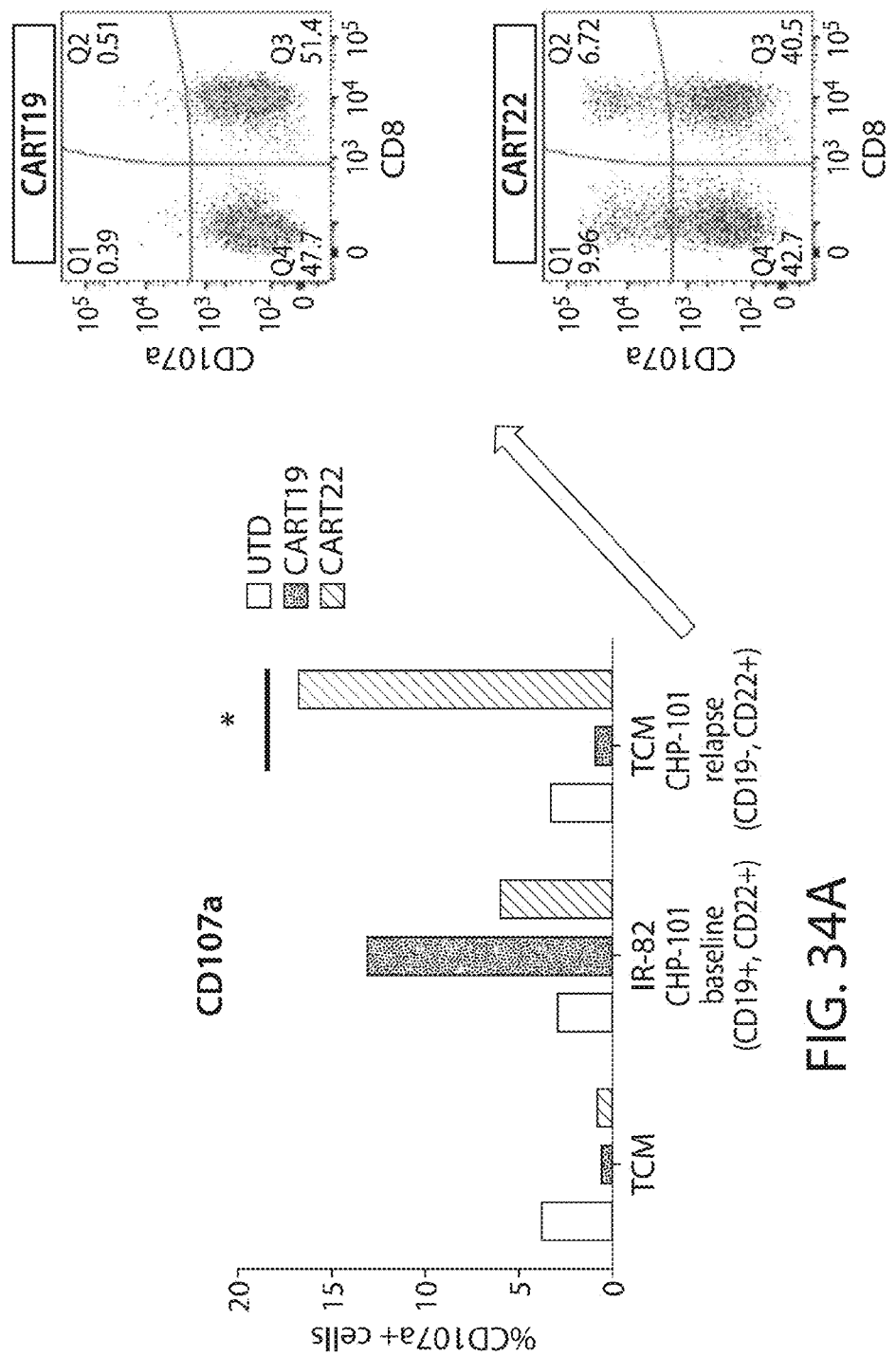
FIGS. 34A and 34B are a series of graphs showing T-cell degranulation with primary ALL blasts. CART22, CART19 and UTD cells were co-incubated for 4 hours with blasts derived from an ALL patient (CHP-959-101) at baseline and after CART19 treatment when the patient relapsed with a CD19-neg disease. Both CART19 and CART22 were able to degranulate at baseline (when blasts are CD19+ and CD22+) but at relapse only CART22 was degranulating (when the disease is CD19-neg) (FIG. 34A). Dot-plots showing CD107a degranulation in CD8-pos and CD8-neg CART19 and CART22 effector after incubation with CHP101 sample at relapse demonstrate only CART22 showed degranulation in both CD8 and CD4 T cells (FIG. 34B). Gating strategy: FSS vs SSC lymphocytes→singlets→live→CD3+.

CART22, CART19 and UTD cells were co-incubated for 4 hours with blasts derived from an ALL patient (CHP-959-101) at baseline and after CART19 treatment when the patient relapsed with a CD19-negative disease. Degranulation was measured. Both CART19 and CART22 were able to degranulate at baseline (when blasts are CD19+ and CD22+) but at relapse only CART22 was degranulating (when the disease is CD19-negative) (FIG. 34A). CD107a degranulation was measured in CD8-positive and CD8-negative CART19 and CART22 effector after incubation with CHP101 sample at relapse. Only CART22 showed degranulation in both CD8 and CD4 T-cells (FIG. 34B). (Gating strategy: FSS vs SSC lymphocytes→singlets→live→CD3+).

Figure 35A:
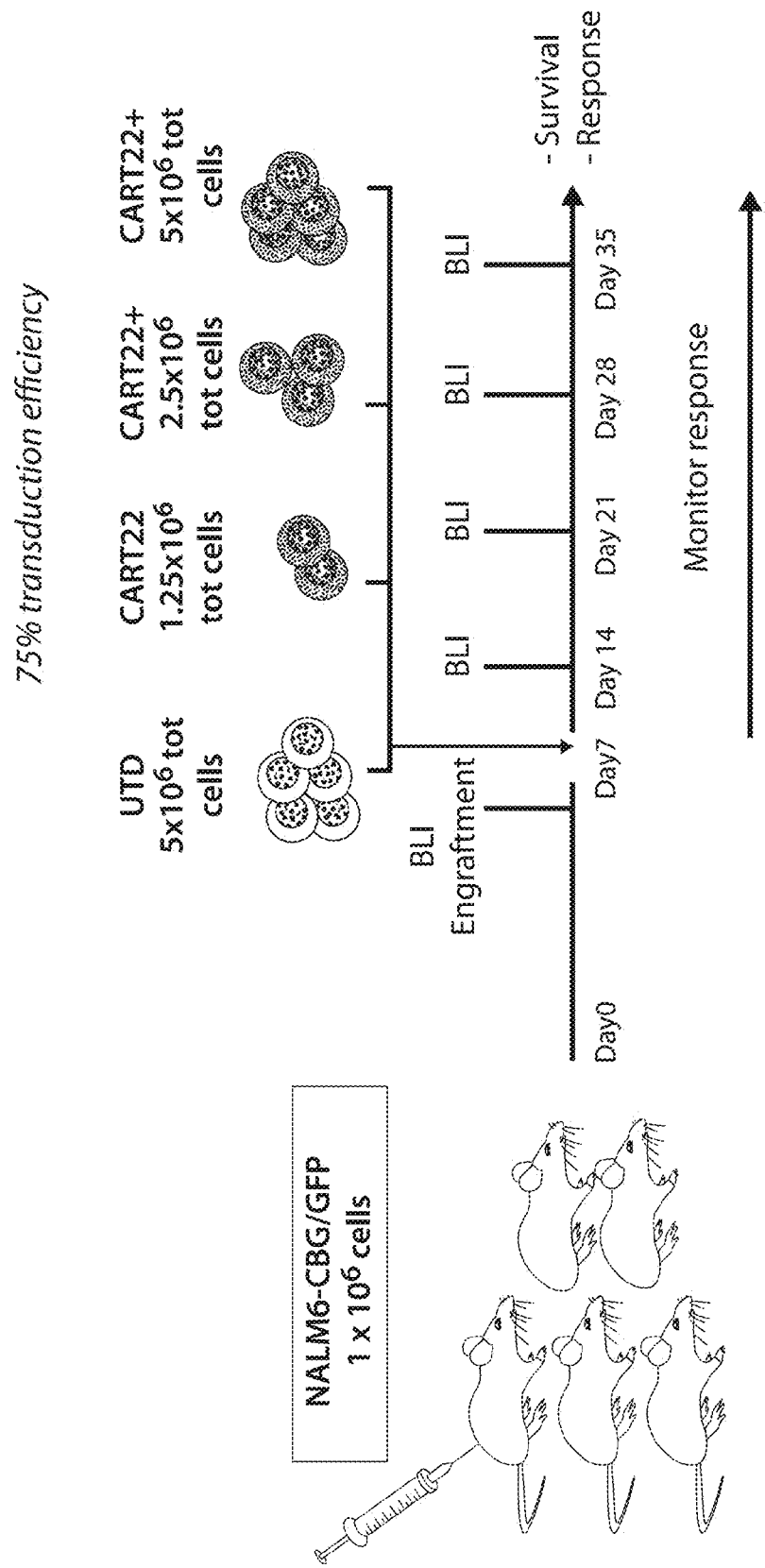
FIGS. 35A, 35B, 35C, and 35D are a series of graphs showing in vivo CART22 efficacy against NALM-6. A. Schema of the experiment: 1 million NALM-6 luciferase+ cells/mouse were injected i.v. in NSG mice. After 6 days tumor engraftment was assessed by bioluminescence. Mice were then randomized to receive untransduced T cells or different doses of CART22 (from 1.25 to 5 million total cells/mouse, with 75% CAR expression). Mice were then monitored for tumor burden, PB T cell expansion, and survival (FIG. 35A). Tumor burden by bioluminescence (BLI) detected a dose-related anti leukemia response. Mice receiving $5e^6$ CART22 cells showed better tumor control (FIG. 35B). CART22 treated mice showed a statistically significant better overall survival (OS) in comparison to mice treated with UTD cells. For OS there was a significant correlation between higher dose of CART22 and better OS (FIG. 35C). T-cell in vivo expansion was monitored weekly by retro-orbital bleedings. One week after T cell infusion mice receiving the higher dose of CART22 showed better CART expansion (median of 12 T cells/0) (FIG. 35D).
Figure 35B:
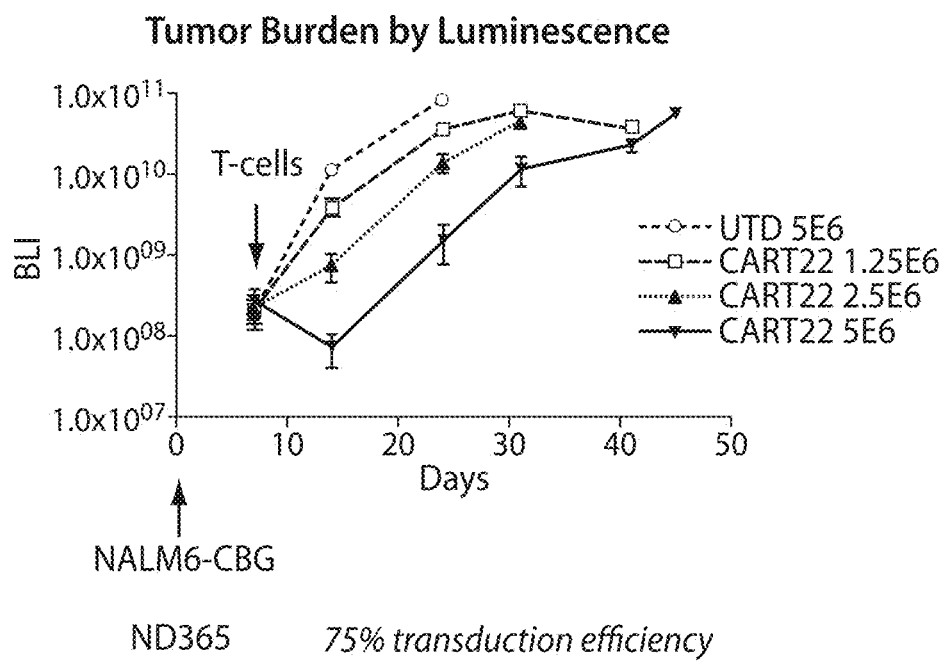
Figure 35C:
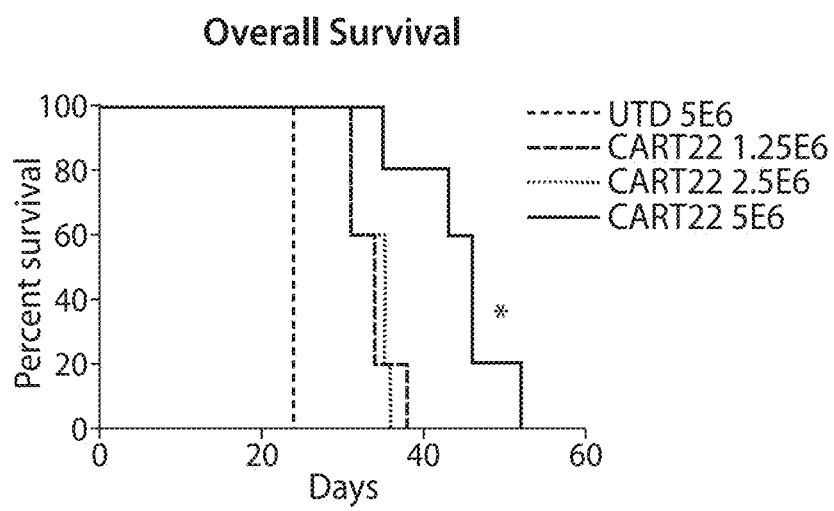
Figure 35D:
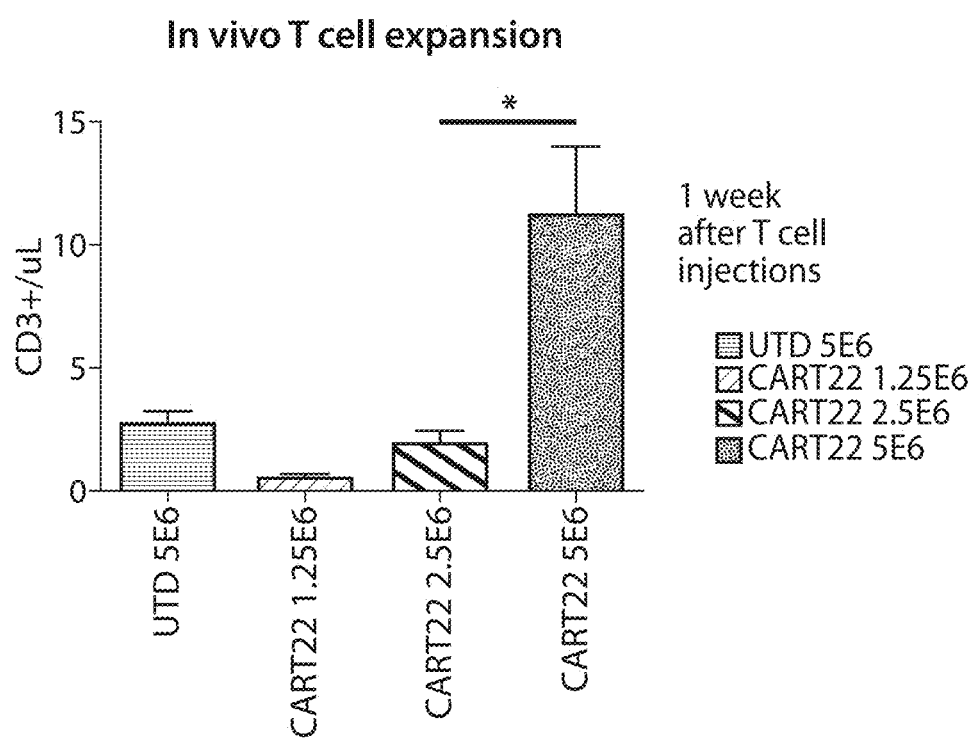

In vivo CART22 efficacy against NALM-6 was assessed as follows: 1 million NALM-6 luciferase+ cells/mouse were injected i.v. in NSG mice. After 6 days tumor engraftment was assessed by bioluminescence. Mice were then randomized to receive untransduced T-cells or different doses of CART22 (from 1.25 to 5 million total cells/mouse, with 75% CAR expression). Mice were then monitored for tumor burden, PB T cell expansion, and survival (FIG. 35A). Tumor burden by bioluminescence (BLI) was measured and dose-related anti leukemia response was observed. Mice receiving 5e6 CART22 cells showed better tumor control (FIG. 35B). CART22 treated mice showed a statistically significant better overall survival (OS) in comparison to UTD treated mice. Also for OS there was a significant correlation between higher dose of CART22 and better OS (FIG. 35C). T-cell in vivo expansion was monitored weekly by retro-orbital bleedings. One week after T cell infusion mice receiving the higher dose of CART22 showed the better CART expansion (median of 12 T cells/µl) (FIG. 35D).

Figure 36A:
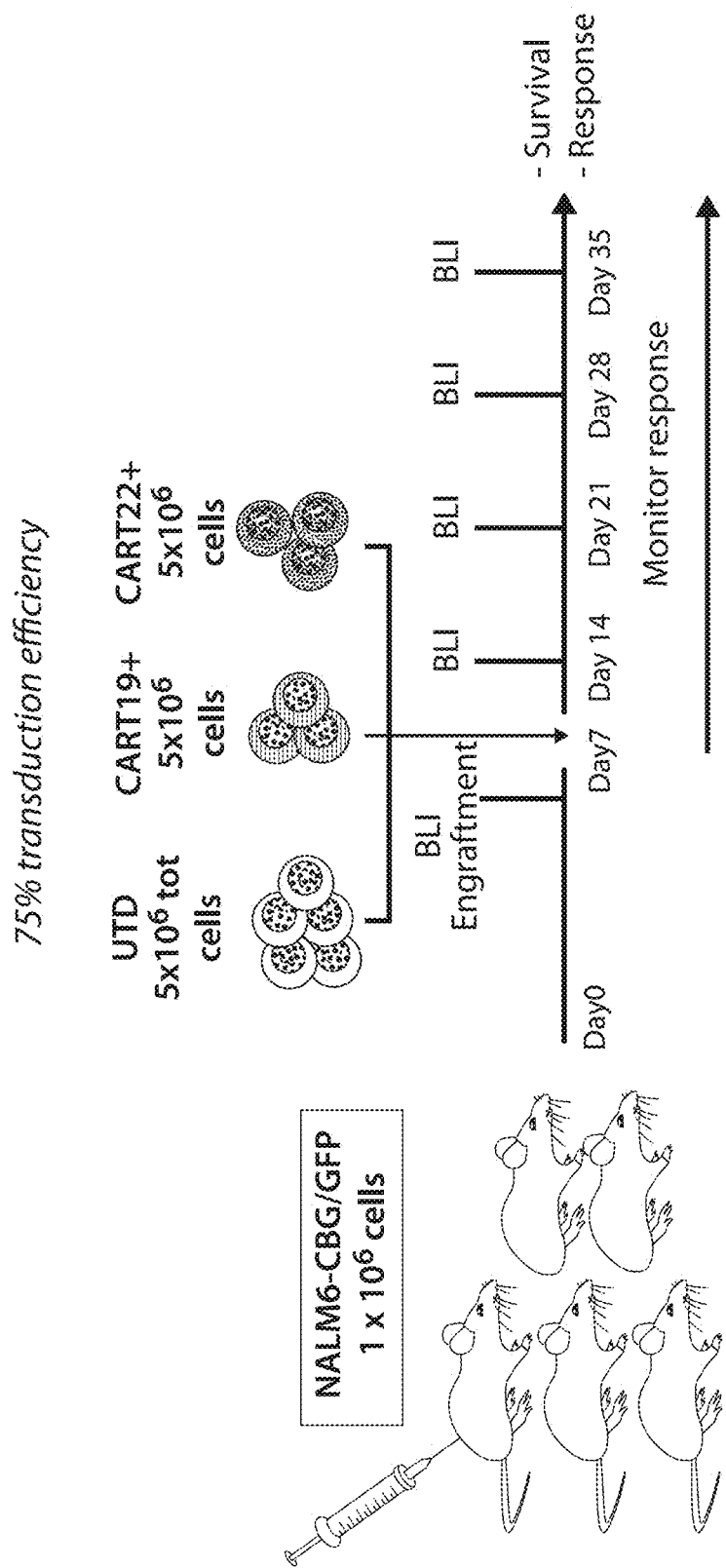
FIGS. 36A and 36B are a series of graphs showing an in vivo comparison between CART22 and CART19 against NALM-6. Schema of the experiment: 1 million NALM-6 luciferase+ cells/mouse were injected i.v. in NSG mice. After 6 days tumor engraftment was assessed by bioluminescence. Mice were then randomized to receive untransduced T cells, CART19 or CART22 (5 million total cells, with 75% CAR expression). Mice were then monitored for tumor burden, PB T cell expansion, and survival (FIG. 36A). Tumor burden by bioluminescence (BLI) demonstrated anti leukemia response in both CART22 and CART19 treated mice, while UTD mice rapidly progressed (FIG. 36B). CART19 treated mice showed better overall survival (OS) in comparison to CART22, possibly due to the different target expression in NALM-6 (CD19>>CD22) (FIG. 36C).
Figure 36B:
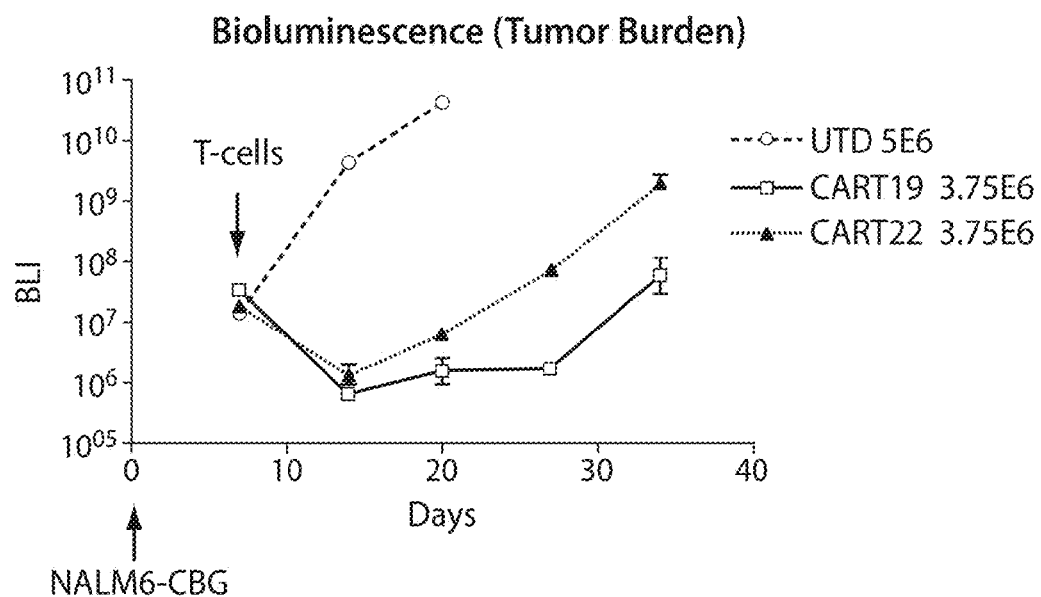
Figure 36C:
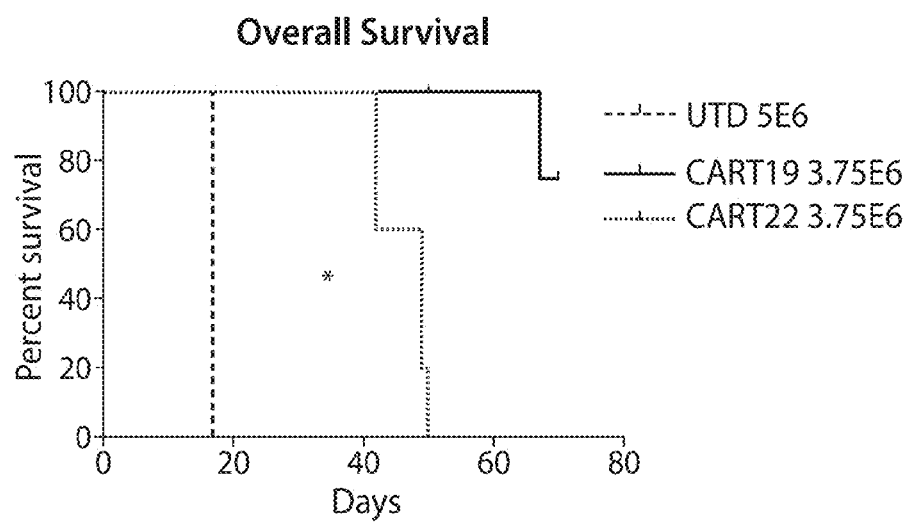

In vivo comparison between CART22 and CART19 against NALM-6 was assessed as follows: 1 million NALM-6 luciferase+ cells/mouse were injected i.v. in NSG mice. After 6 days tumor engraftment was assessed by bioluminescence. Mice were then randomized to receive untransduced T-cells, CART19 or CART22 (5 million total cells, with 75% CAR expression). Mice were then monitored for tumor burden, PB T-cell expansion, and survival (FIG. 36A). Tumor burden by bioluminescence (BLI) was measured and anti-leukemia response was observed in both CART22 and CART19 treated mice, while UTD mice rapidly progressed (FIG. 36B). CART19 treated mice showed better overall survival (OS) in comparison to CART22, possibly due to the different target expression in NALM-6 (CD19>>CD22) (FIG. 36C).

Figure 37A:
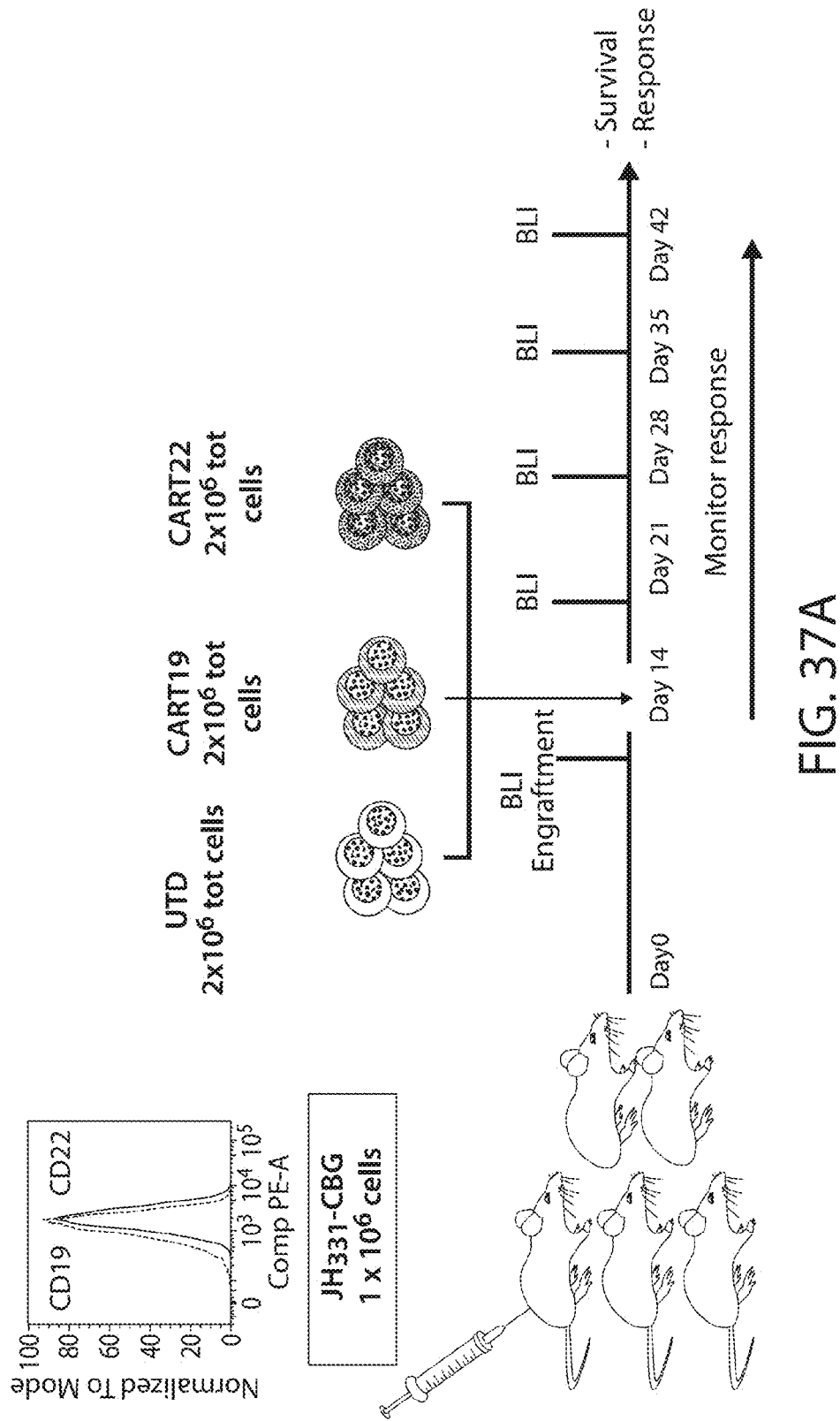
FIGS. 37A and 37B are a series of graphs showing an in vivo comparison between CART22 and CART19 in a model of primary ALL. The blasts of a primary ALL patient (JH331) were passaged in vivo and transduced with luciferase to follow tumor burden. Schema of the experiment: 1 million JH331 luciferase+ cells/mouse were injected i.v. in NSG mice. After 14 days tumor engraftment was assessed by bioluminescence. Mice were then randomized to receive untransduced T cells, CART19 or CART22 (5 million total cells, with 75% CAR expression). Mice were then monitored for tumor burden, PB T cell expansion, and survival (FIG. 37A). Tumor burden by bioluminescence (BLI) detected anti leukemia response in both CART22 and CART19 treated mice, while UTD mice rapidly progressed (FIG. 37B).
Figure 37B:
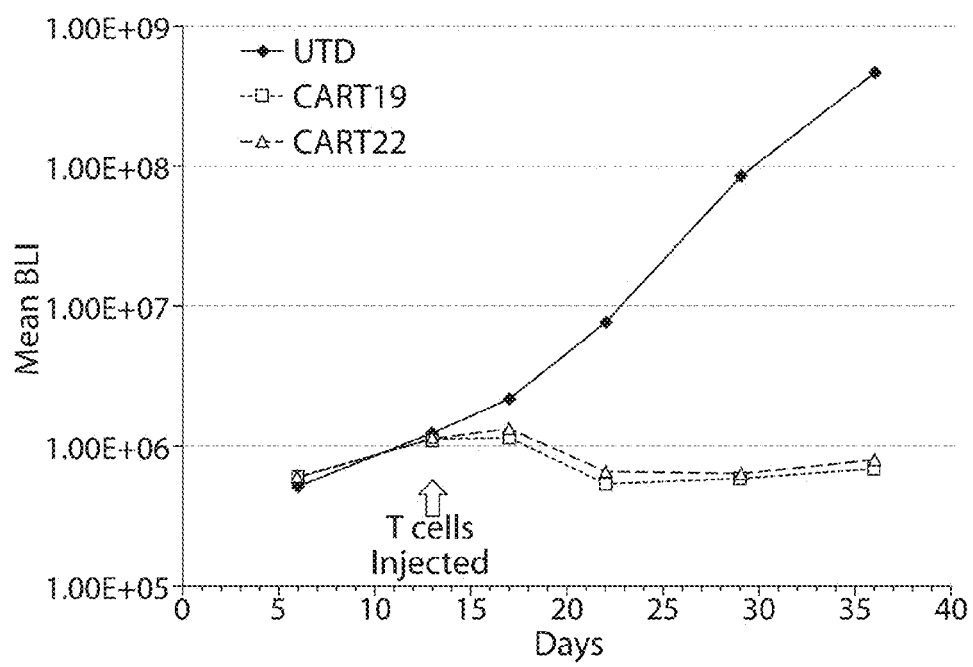

CART22 and CART19 were compared in vivo in a model of primary ALL. The blasts of a primary ALL patient (JH331) were passaged in vivo and transduced with luciferase to follow tumor burden. 1 million JH331 luciferase+ cells/mouse were injected i.v. in NSG mice. After 14 days tumor engraftment was assessed by bioluminescence. Mice were then randomized to receive untransduced T-cells, CART19 or CART22 (5 million total cells, with 75% CAR expression). Mice were then monitored for tumor burden, PB T-cell expansion, and survival (FIG. 37A). Tumor burden by bioluminescence (BLI) was measured and anti-leukemia response was observed in both CART22 and CART19 treated mice, while mice treated with UTD cells rapidly progressed (FIG. 37B).

Figure 38A:
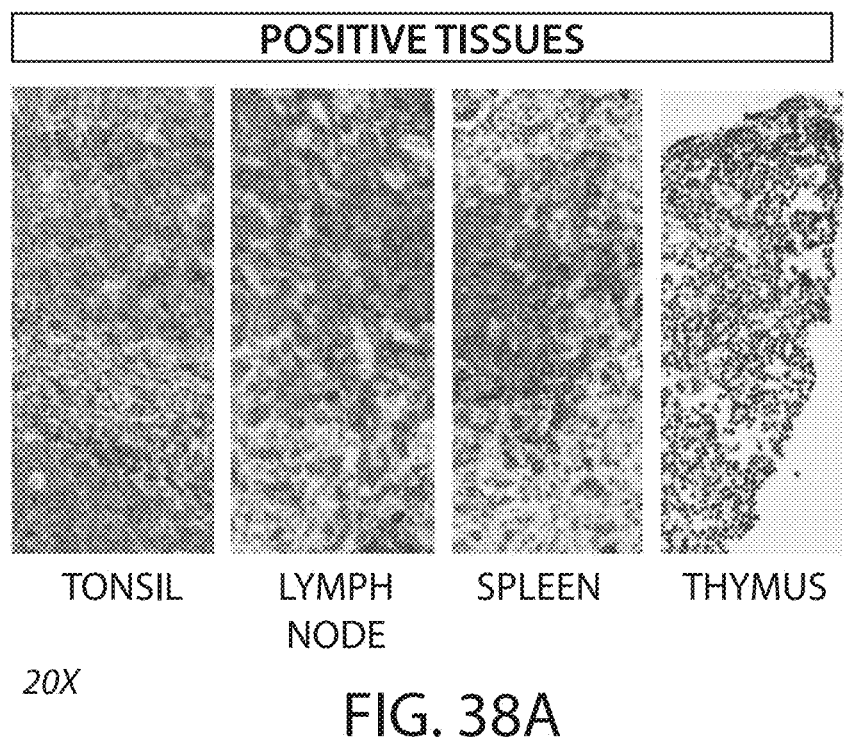
FIGS. 38A, 38B, and 38C are a series of images showing tissue microarrays for CD22 expression on 28 human normal tissues by immunohistochemistry staining. Lymphoid organs resulted positive for CD22 expression (tonsil, lymph node, spleen and thymus) (FIG. 38A). Non-lymphoid organs showed no expression of CD22 (FIG. 38B). CD22-positive resident B-cells were observed in multiple tissues (FIG. 38C). *=non-specific staining.
Figure 38B:
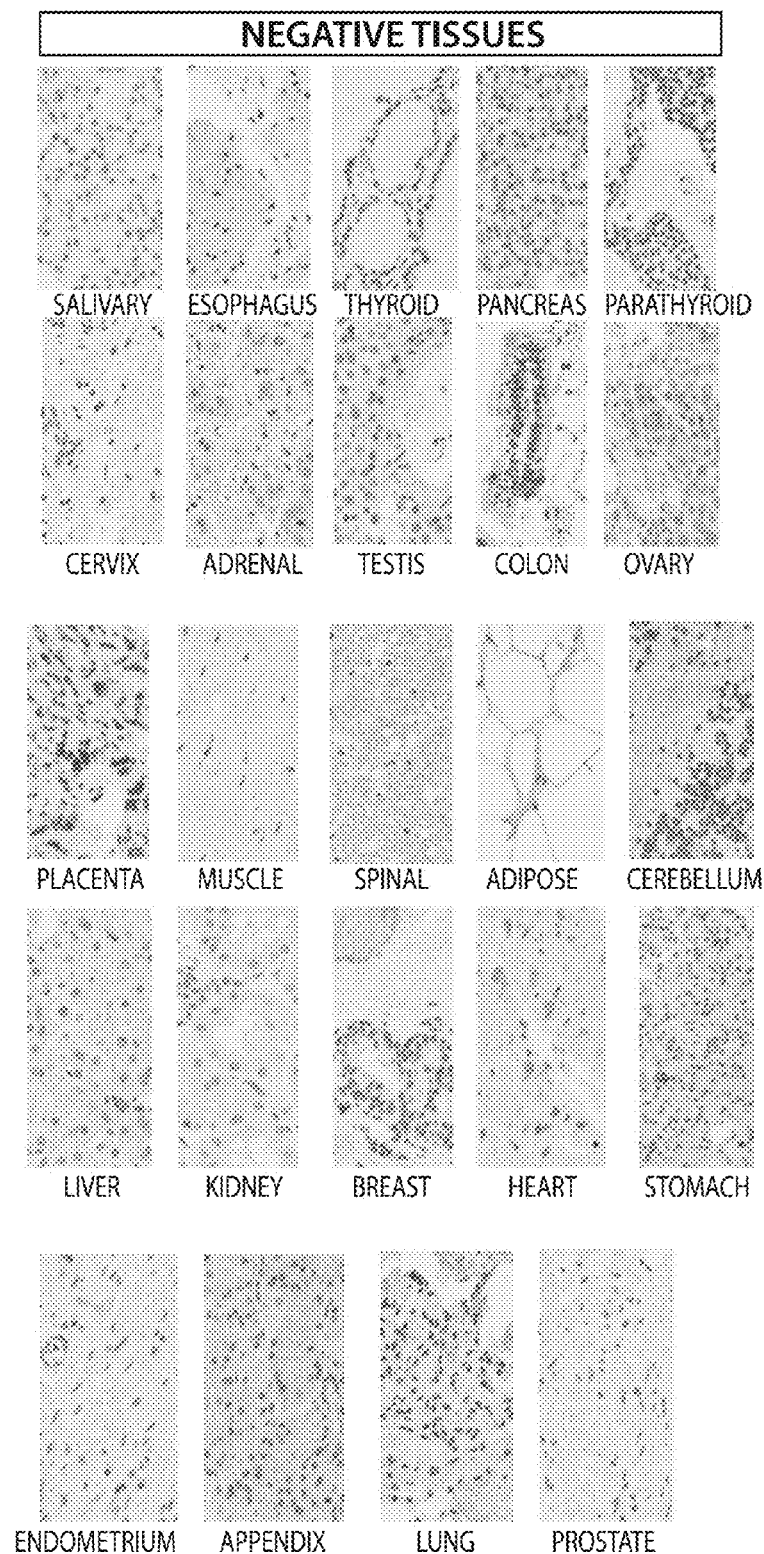
Figure 38C:
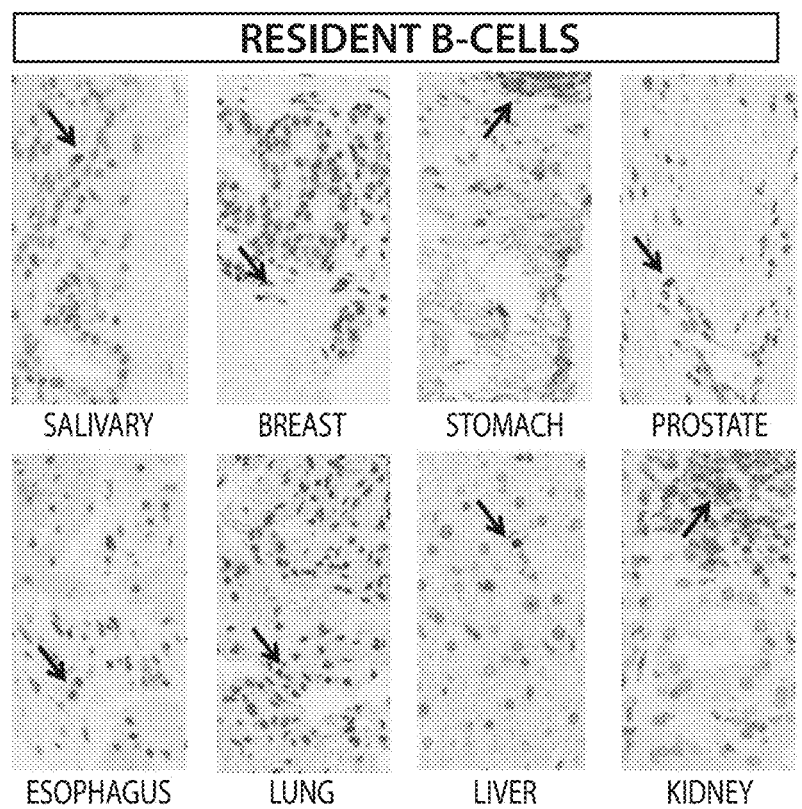
Figure 39A:
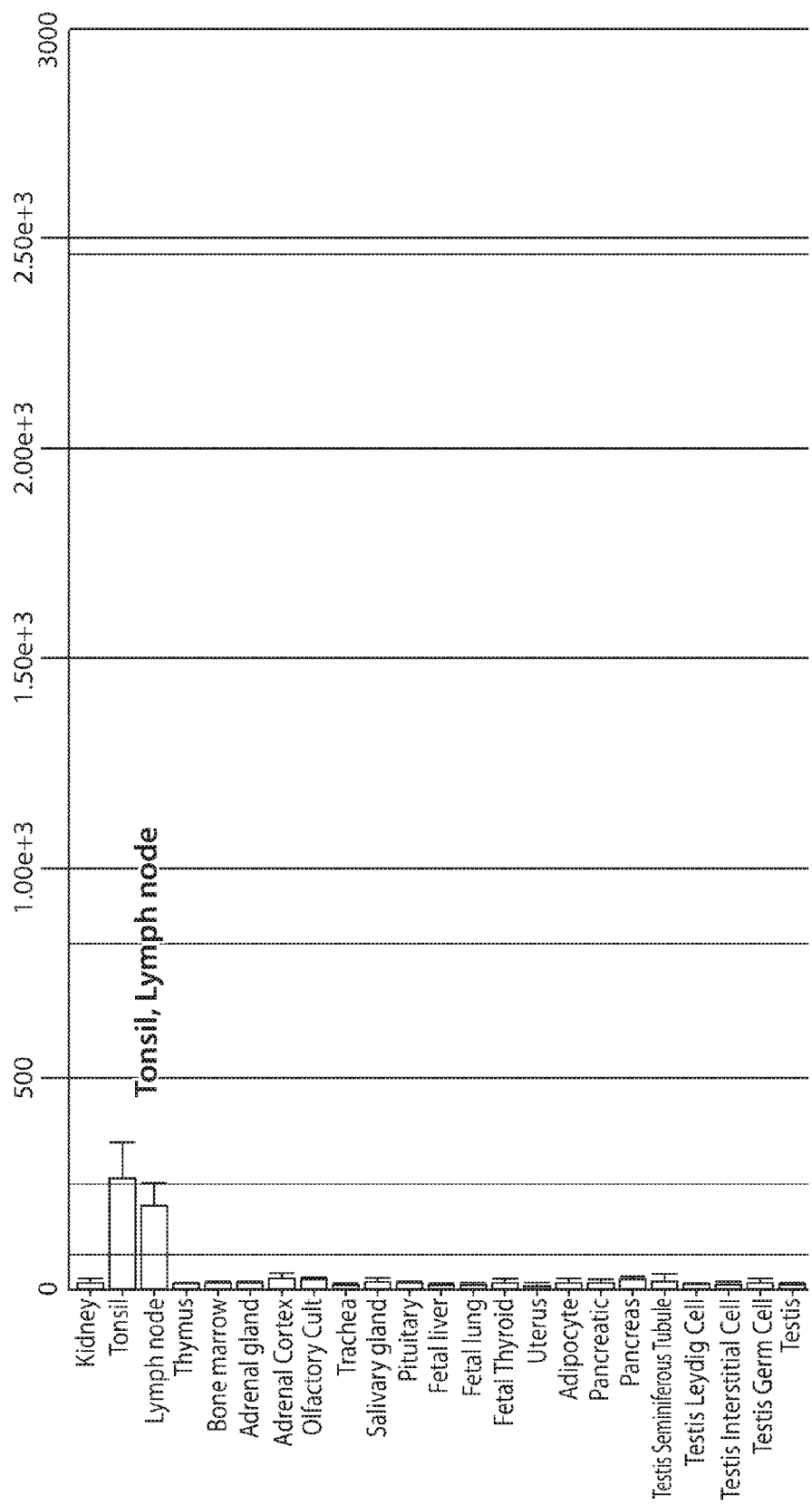
Figure 39B:
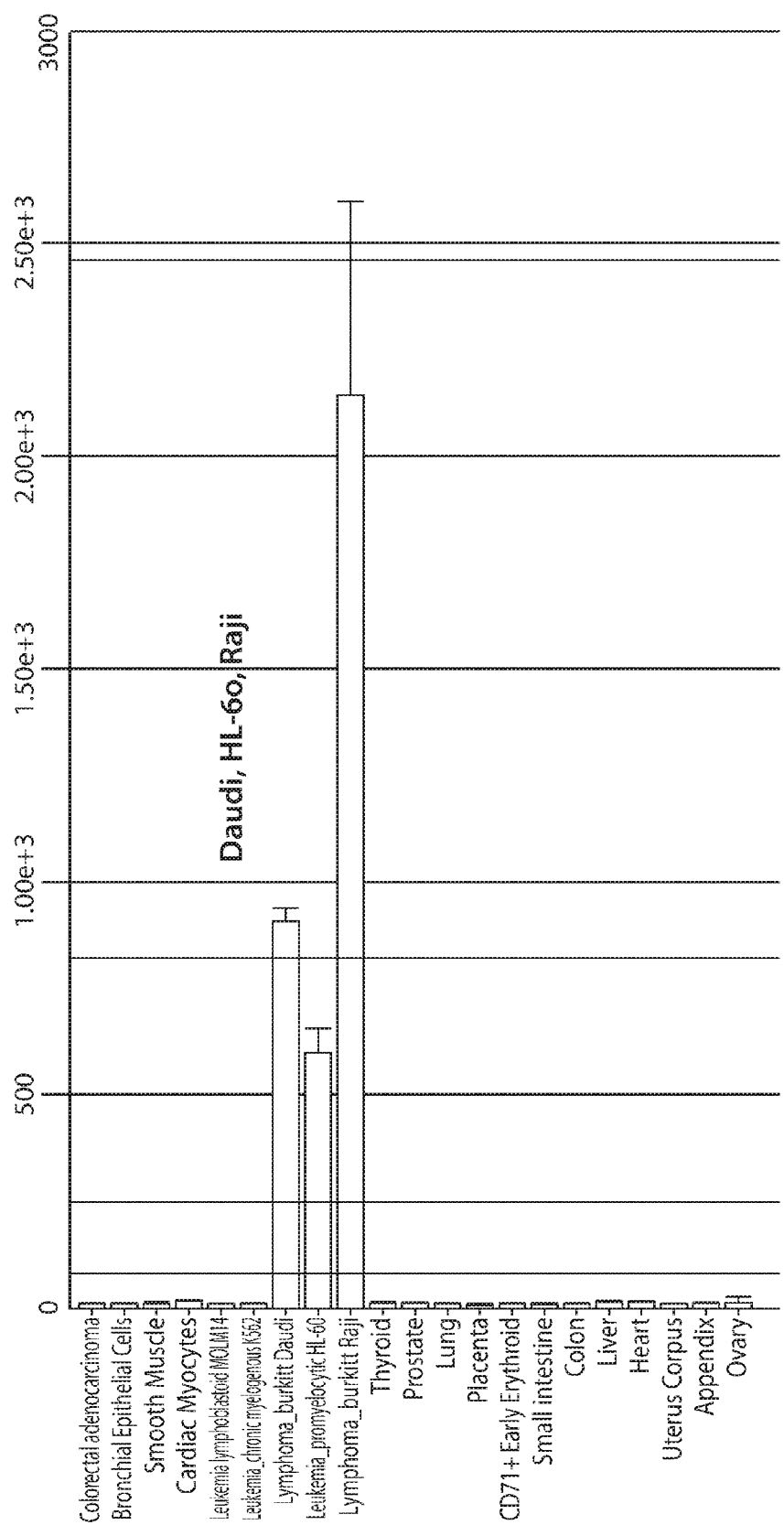
Figure 39C:
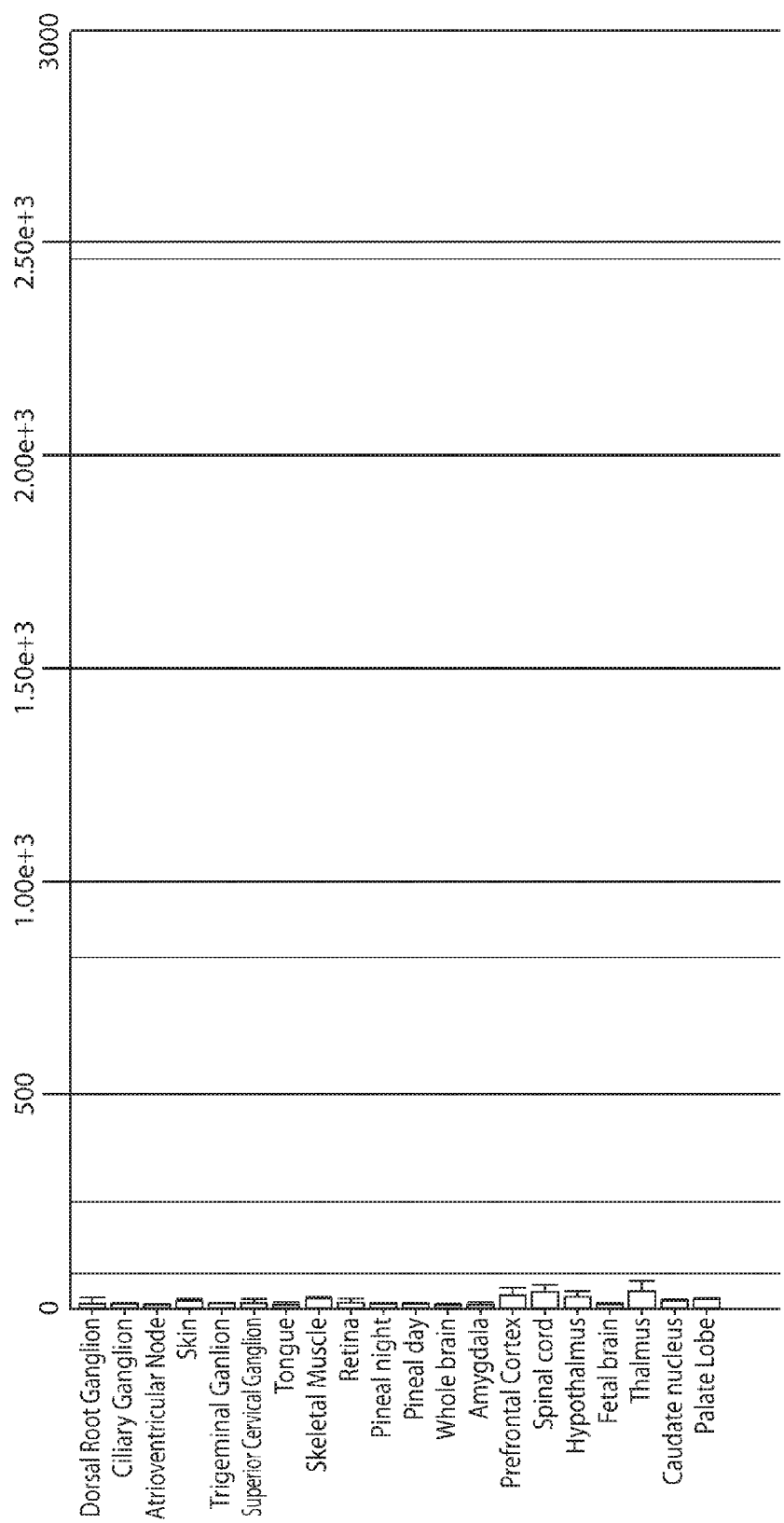

Tissue microarrays for CD22 expression were performed on 28 human normal tissues by immunohistochemistry staining. Lymphoid organs resulted positive for CD22 expression (tonsil, lymph node, spleen and thymus) (FIG. 38A). All non-lymphoid organs showed no expression of CD22 (FIG. 38B). CD22-positive resident B-cells were observed in multiple tissues (FIG. 38C).

CD22 RNA expression was observed at high level in B-cells, tonsil and lymph nodes, as shown in expression data from GeneAtlas U133A. B-lymphoblast and leukemia/lymphoma cell lines were also highly positive (FIGS. 39A, 39B, 39C and 39D).

Figure 40:
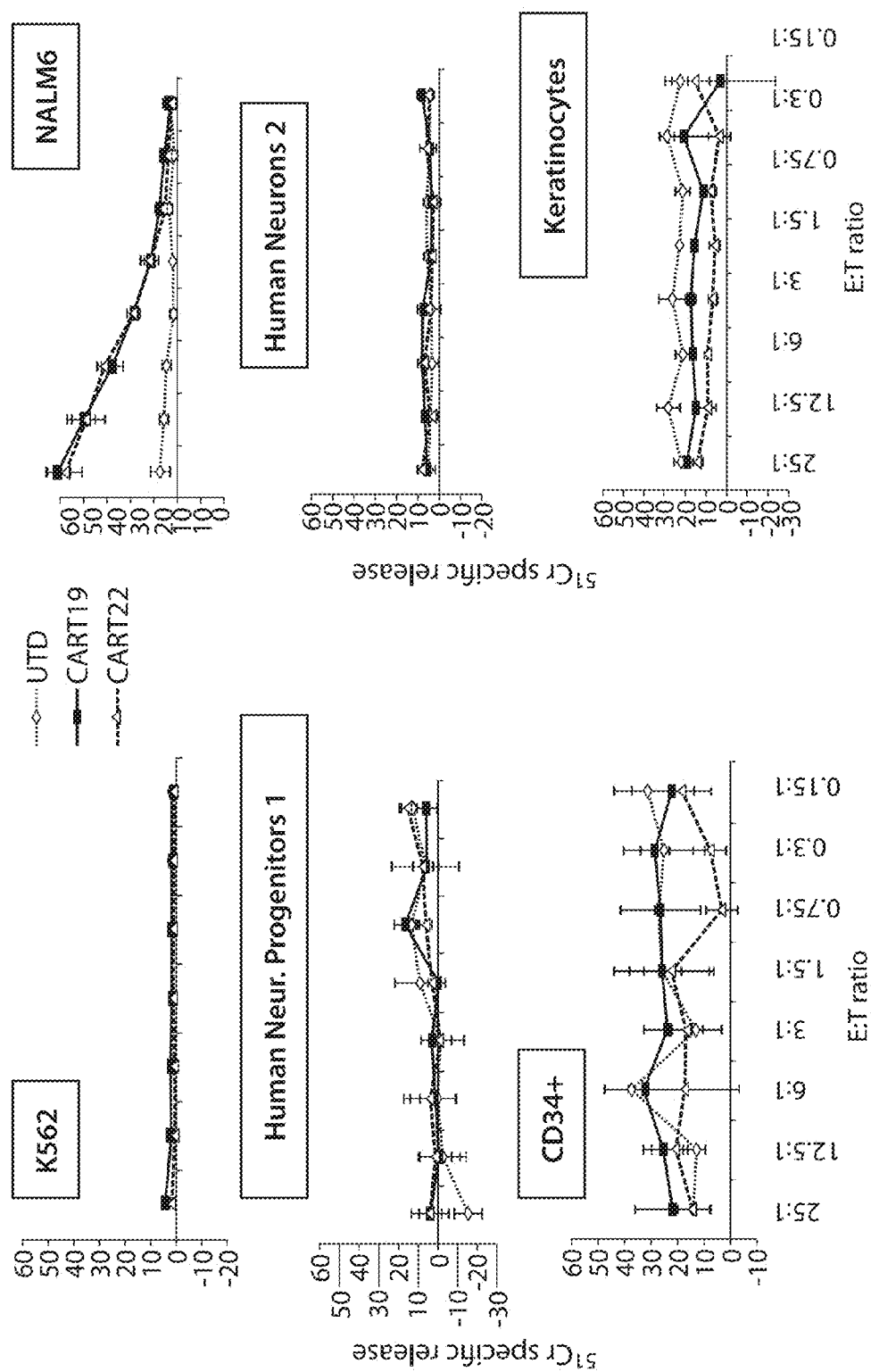
FIG. 40 is a series of graphs showing a 51-Chromium-release assay for CART22 toxicity. Both CART22 and CART19 but not UTD cells triggered the lysis of the ALL cell line NALM-6. No cytotoxic effect of CART22 was observed in any normal tissue (CD34+, human neuronal progenitors or neurons and keratinocytes) or control (K562 cell line).

Both CART22 and CART19 but not UTD cells triggered the lysis of the ALL cell line NALM-6 in a 51-Chromium-release assay for CART22 toxicity (FIG. 40). No cytotoxic effect of CART22 was observed in any normal tissue (CD34+, human neuronal progenitors or neurons and keratinocytes) or control (K562 cell line).

Example 17: Combination of Anti-CD123 and Anti-CD19 CAR T Cells for the Treatment and Prevention of Antigen-Loss Relapse Chemo-refractory or relapsing (r/r) B-cell acute lymphoblastic leukemia (B-ALL) is associated with a poor prognosis but, as demonstrated recently, remains exquisitely sensitive to the immune system. In particular, anti-CD19 chimeric antigen receptor T cells (CART19, CTL019) and bi-specific anti-CD19/CD3 antibodies (blinatumomab) generate unprecedented complete response rates of 45-90% in this patient population. Both approaches re-direct autologous T cells to recognize CD19-expressing cells. Blinatumomab uses a continuous long-term infusion of a bispecific construct that combines an anti-CD19 single chain variable fragment (scFv) with an anti-CD3 scFv; in the case of CART19 T cells are genetically modified to express an anti-CD19 scFv fused to the T cell receptor signaling with built-in co-stimulatory domains. A recent study showed that 90% of patients with r/r B-ALL treated with CTL019 reach complete remission (CR) with an overall survival (OS) of 78% at 6 months. Encouraging results with CART19 were also obtained in patients with other B-cell neoplasms, such as chronic lymphocytic leukemia and non-Hodgkin lymphoma.

However, a subset of patients treated with CART19 or blinatumomab develops relapse and a significant portion of these relapses are characterized by the loss of CD19. In B-ALL, CD19-negative relapses have been reported in 10-20% of patients following CART19 or blinatumomab therapies and it has not been described in the setting of other treatments; overall about 30% of relapses after blinatumomab and up to 50% after CART19 are CD19-negative. CD19 is a prototypic B-cell marker that is expressed from the very earliest stages of B cell development to the mature B-cell. CD19 plays an important role in B cell biology as CD19-deficient B cells exhibit selective growth disadvantage. Thus the absence of CD19 is a very unusual finding in B-ALL and it is has been reported in only rare patients prior to the era of potent CD19-directed immunotherapies. The possible mechanism of antigen loss is currently under investigation and is most likely caused by selective pressure on leukemia sub-clones by these powerful anti-CD19 agents. Because of the recent approval by the FDA of blinatumomab and the breakthrough status accorded to CTL019, it is likely that increasing numbers of patients with r/r B-ALL will be treated with these agents. Hence, novel effective strategies are needed in order to be able to treat those patients that will relapse with CD19-negative blasts after CART19 or blinatumomab. Ideally a new approach would not only treat patients with active antigen-loss relapse but if employed upfront could potentially prevent their occurrence.

The interleukin-3 receptor alpha (or CD123) is involved in hematopoiesis and has been shown to be expressed in several hematologic neoplasms, including acute myeloid leukemia (AML), acute lymphoid leukemia (ALL), plasmacytoid dendritic cell neoplasm, hairy cell leukemia, and Hodgkin lymphoma. Unlike lineage-associated surface antigens such as CD33 (myeloid) or CD19 (B-lymphoid), CD123 is hierarchically expressed on hematopoietic progenitor cells and in AML CD123 is expressed on leukemic stem cells that are involved in resistance to chemotherapy and relapse after initial treatment. Due to these characteristics, CD123 has generated great interest for targeted therapy, and multiple agents are being developed such as the IL3-diphtheria toxin fusion protein (SL-401, DT3881L3), naked anti-CD123 monoclonal antibodies (CSL-360, CSL-362), antibody-drug conjugates, bi-specific antibodies or CD3Fv-IL3 fusion constructs, and more recently, anti-CD123 chimeric antigen receptor T cells. Some of these approaches are currently being validated in clinical trials and many more will be tested in the clinic in the next few years. Targeting CD123 with chimeric antigen receptor T cells (CART123) can lead to deep and long-term responses in human primary AML xenografts and can establish an anti-leukemia T cell memory. Here, CD123 is expressed in CD19-negative B-ALL relapses occurring after CD19-directed therapies and that CAR-123 T cells combined with CART19 (CTL019) is an effective therapy for the treatment and for the prevention of antigen-loss relapses in B-ALL xenografts.

Materials and Methods

Cell Lines and Primary Samples.

Cell lines were originally obtained from ATCC (Manassas, Va.) (K-562) or DSMZ (Braunschweig, Germany) (MOLM-14 and NALM-6). All cell lines were tested for the presence of *mycoplasma* contamination (MycoAlert™ *Mycoplasma* Detection Kit, LT07-318, Lonza, Basel, Switzerland). For some experiments, cell lines were transduced with firefly luciferase/eGFP and then sorted to obtain a >99% positive population. The luciferase positive K-562 cell line was also transduced with truncated CD19 or truncated CD123 to obtain cell lines expressing neither of them, only CD19 or only CD123. MOLM-14 and K562 were used as controls as indicated in the relevant figures. The cell lines were maintained in culture with RPMI media 1640 (Gibco, 11875-085, LifeTechnologies, Grand Island, N.Y.) supplemented with 10% fetal bovine serum (FBS, Gemini, 100-106, West Sacramento, Calif.), and 50 UI/ml penicillin/streptomycin (Gibco, LifeTechnologies, 15070-063). De-identified primary human ALL bone marrow (BM) and peripheral blood (PB) specimens were obtained from the clinical practices of University of Pennsylvania/Children's Hospital of Philadelphia under an Institutional Review Board (IRB)-protocol, purchased from the Stem Cells and Xenograft Core of the University of Pennsylvania or from research samples of the current CTL019 clinical trials (Translation and Correlative Study Laboratory, at the University of Pennsylvania). For all functional studies, primary cells were thawed at least 12 hours before experiment and rested at 37° C.

In Vivo Expansion of Primary B-ALL Blasts.

Methods disclosed in D. M. Barrett, A. E. Seif, C. Carpenito, D. T. Teachey, J. D. Fish, C. H. June, S. A. Grupp, G. S. Reid, Noninvasive bioluminescent imaging of primary patient acute lymphoblastic leukemia: a strategy for preclinical modeling. *Blood* 118, e112-117 (2011).

Fluorescence In Situ Hybridization (FISH) and Immunohistochemistry.

The FISH analysis and immunohistochemistry were performed according to the standard method and as described. (M. A. Belaud-Rotureau, M. Parrens, P. Dubus, J. C. Garroste, A. de Mascarel, J. P. Merlio, A comparative analysis of FISH, RT-PCR, PCR, and immunohistochemistry for the diagnosis of mantle cell lymphomas. *Modern pathology: an official journal of the United States and Canadian Academy of Pathology, Inc* 15, 517-525 (2002)). The FISH analysis was performed according to the standard method. In brief, harvested ALL cells were suspended in fixative (acetic acid and methanol), deposited on the slides, and left to dry. The dual color gene fusion probe BCR/ABL (Abbott Molecular), was applied in the hybridization buffer solution. The slides were cover-slipped, sealed, and left inside the HYBrite chamber at 37 C for 6 hr. After removal of the sealant and the coverslip, the slides were washed twice, blotted, dried, and counterstained with DAPI. The slides were examined under fluorescent microscope, with a minimum of 200 nuclei evaluated in each specimen.

Generation of CAR Constructs and CAR T Cells.

The murine anti-CD19 chimeric antigen receptor (CD8 hinge, 4-1BB co-stimulatory domain and CD3 zeta signaling domain) was generated as previously described. (Milone, et al., *Molecular therapy: the journal of the American Society of Gene Therapy* 17, 1453-1464 (2009) and Imai, et al., *Leukemia* 18, 676-684 (2004)). This is the same construct currently used in the CTL019 clinical trials at the University of Pennsylvania. For CAR123 scFv anti-CD123 (1172 construct (SEQ ID NO: 707, and as described in PCT/US2014/017328) was used and the same backbone construct of CAR19. Production of CAR-expressing T cells was performed as previously described. (Gill, et al., *Blood* 123, 2343-2354 (2014)). Normal donor CD4 and CD8 T cells or PB mononuclear cells (PBMC) were obtained from the Human Immunology Core of the University of Pennsylvania. T cells were plated at $1\times10^6$/ml with a CD4:CD8 ratio of 1:1 and expanded in X-vivo 15 media (Lonza, 04-418Q), supplemented with human AB serum 5% (Gemini, 100-512), penicillin/streptomycin (Gibco, 15070063) and Glutamax (Gibco, 35050061) using anti-CD3/CD28 Dynabeads (Life Technologies, 11161D) added on the day 1 of culture and removed on day 6. T cells were transduced with lentivirus on day 2. T cells were expanded in culture for 8-15 days and harvested when the median cell volume was below 300 fl. T cells were then cryopreserved in FBS with 10% DMSO for future experiments. Prior to all experiments, T cells were thawed and rested overnight at 37° C.

Multiparametric Flow Cytometry.

Flow cytometry was performed as previously described (Kenderian, et al., *Leukemia,* (2015)). Anti-human antibodies were purchased from Biolegend, eBioscience, or Becton Dickinson. Cells were isolated from in vitro culture or from animals, washed once in PBS supplemented with 2% fetal calf serum, and stained for 15 minutes at room temperature. For cell number quantitation, Countbright (Invitrogen) beads were used according to the manufacturer's instructions. In all analyses, the population of interest was gated based on forward vs. side scatter characteristics followed by singlet gating, and live cells were gated using Live Dead Fixable Aqua (Invitrogen). Time gating was included for quality control. Surface expression of CAR19 was detected as previously described, using an anti-idiotype antibody. Detection of CAR123 was performed using goat-anti-mouse antibody (Jackson Laboratories) or CD123-Fc/His (Sino Biologicals) and anti-His-APC (R&D) or PE (AbCam). Flow cytometry was performed on a four-laser Fortessa-LSR II cytometer (Becton-Dickinson) and analyzed with FlowJo X 10.0.7r2 (Tree Star).

In Vitro T-Cell Effector Function Assays.

Degranulation, CFSE proliferation, cytotoxicity assays and cytokine measurements were performed as previously described. (Gill, et al., Blood 123, 2343-2354 (2014) and Kalos, et al., *Science translational medicine* 3, 95ra73 (2011)).

Degranulation Assay.

Briefly, T cells were incubated with target cells at a 1:5 ratio in T cell media. Anti-CD107a-PECY7 (Biolegend), anti-CD28 (BD Biosciences), anti-CD49d (BD Biosciences) antibodies and monensin (BD Biosciences) were added to the co-culture. After 4 hours, cells were harvested and stained for CAR expression, CD3, CD8 and Live Dead aqua staining (Invitrogen). Cells were fixed and permeabilized (Invitrogen Fix/Perm buffers) and intracellular staining was then performed to detect multiple cytokines (IFN, TNFα, IL-2, GM-CSF, MIP1β).

Proliferation Assay.

T cells were washed and resuspended at $1\times10^7$/ml in 100 ul of PBS and stained with 100 ul of CFSE 2.5 uM (Invitrogen) for 5 minutes at 37° C. The reaction was then quenched with cold media, and cells were washed three times. Targets were irradiated at a dose of 100 Gy. T cells were incubated at a 1:1 ratio with irradiated target cells for 120 hours, adding media at 24 hours. Cells were then harvested, stained for CD3, CAR and Live Dead aqua (Invitrogen), and Countbright beads (Invitrogen) were added prior to flow cytometric analysis for absolute quantification.

Cytotoxicity Assays.

Luciferase/eGFP+ cell lines were used for cytotoxicity assay as previously described. In brief, targets were incubated at the indicated ratios with effector T cells for 24 hours. Killing was calculated by bioluminescence imaging on a Xenogen IVIS-200 Spectrum camera.

Cytokine Measurements.

Effector and target cells were co-incubated at a 1:1 ratio in T cell media for 24. Supernatant was harvested and analyzed by 30-plex Luminex array (Luminex Corp, FLEX-MAP 3D) according to the manufacturer's protocol (Invitrogen).

Animal Experiments.

In vivo experiments were performed as previously described. (Kenderian, et al., Leukemia, (2015)). Schemas of the utilized xenograft models are discussed in detailed in the relevant figures, result. NOD-SCID-γ chain−/− (NSG) originally obtained from Jackson Laboratories were purchased from the Stem Cell and Xenograft Core of the University of Pennsylvania. All experiments were performed according a protocol (#803230) approved by the Institutional Animal Care and Use Committee (IACUC) that adheres to the NIH Guide for the Care and Use of Laboratory Animals. Cells (leukemia cell lines or T cells) were injected in 200 ul of PBS at the indicated concentration into the tail veins of mice. Bioluminescent imaging was performed using a Xenogen IVIS-200 Spectrum camera and analyzed with LivingImage software v. 4.3.1 (Caliper Life-Sciences). Animals were euthanized at the end of the experiment or when they met pre-specified endpoints according to the IACUC protocols.

Multiphoton Microscopy.

Mice were anaesthetized and maintained at core temperature of 37° C. Bone marrow was imaged after removing the scalp and immobilizing the skull. Imaging was performed using a Leica SP5 2-photon microscope system (Leica Microsystems) equipped with a picosecond laser (Coherent). Each imaging acquisition lasted 20 min followed by an assessment of mouse sedation. CellTrace Violet, GFP, and CellTrace Orange (or TRITC) were excited using laser light of 850 nm. Images were obtained using a 20× water-dipping lens. The resulting images were analyzed with Volocity software (PerkinElmer).

Statistical Analysis.

All statistics were performed as indicated using GraphPad Prism 6 for Windows, version 6.04 (La Jolla, Calif.). Student's t-test was used to compare two groups; in analysis where multiple groups were compared, one-way analysis of variance (ANOVA) was performed with Holm-Sida correction for multiple comparisons. When multiple groups at multiple time points/ratios were compared, the Student's t-test or ANOVA for each time points/ratios was used. Survival curves were compared using the log-rank test. In the figures asterisks are used to represent p-values (*=<0.05, =<0.01, *=<0.001, ****=<0.0001) and "ns" means "not significant" (p>0.05). Further details of the statistics for each experiment are listed in figure legends.

Results

Figure 49A:
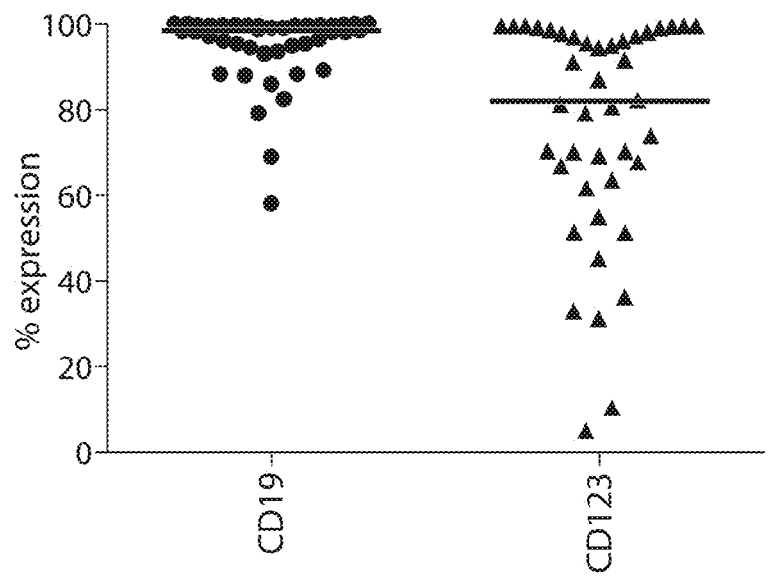
FIGS. 49A, 49B, 49C, 49D, 49E, and 49F show CD123 is highly expressed in CD19-neg B-cell acute lymphoblastic leukemia relapses occurring after CART19 treatment.
Figure 49B:
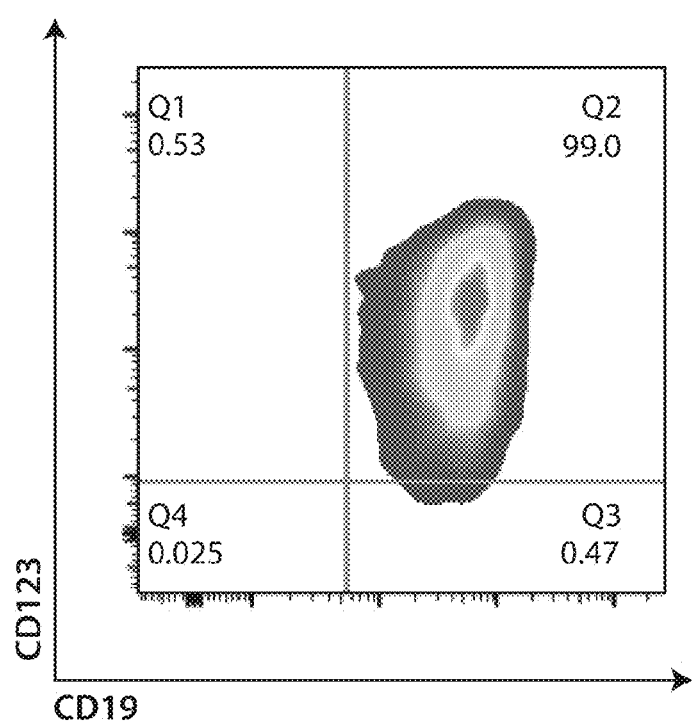
Figure 49C:
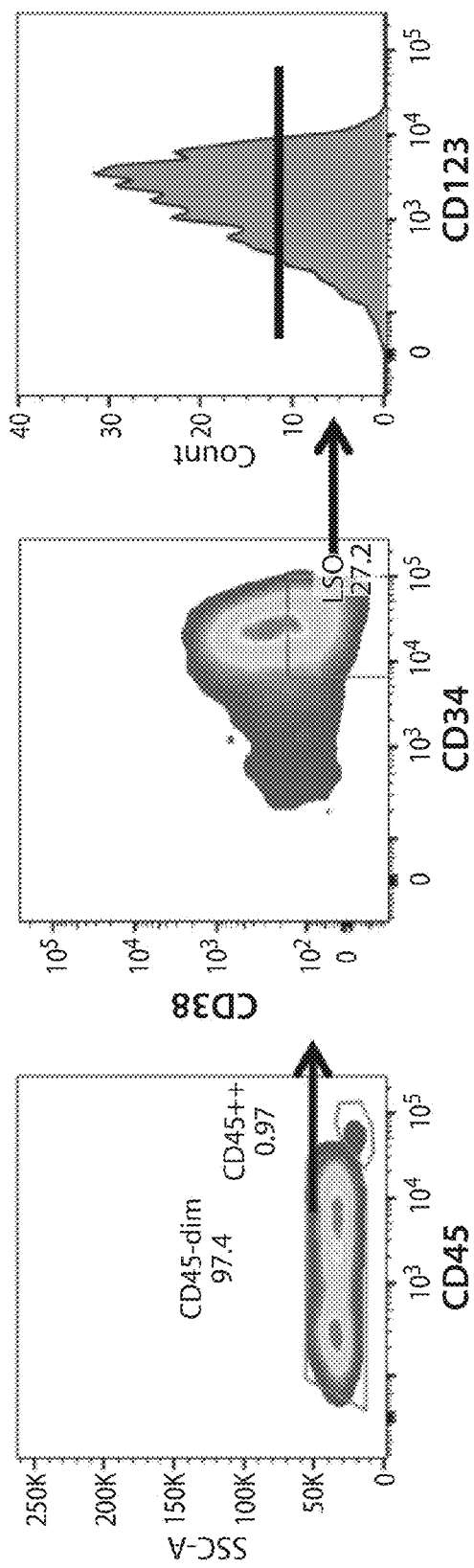
Figure 49D:
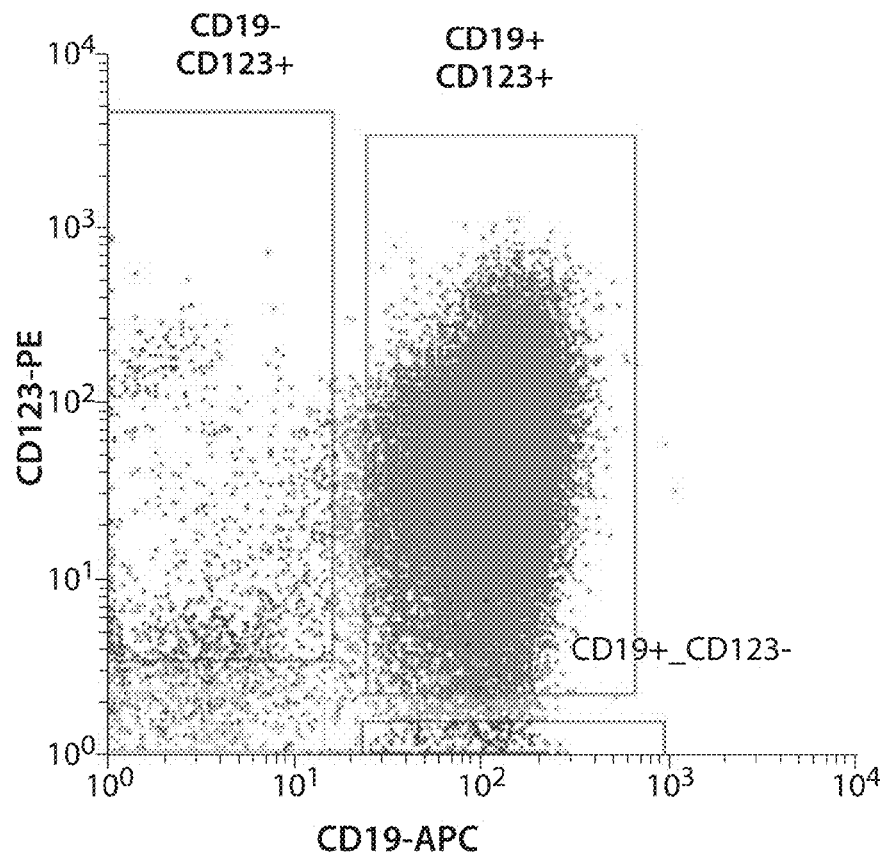
Figure 49D:
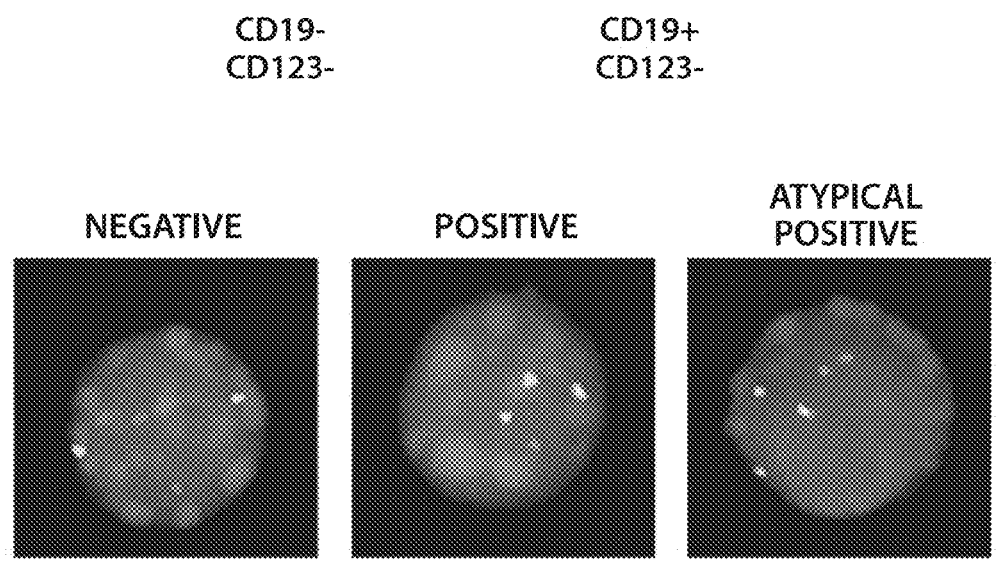

CD123 is Expressed in B-ALL, in the Leukemia Stem Cells and in CD19-Negative Relapses In order to evaluate the expression of CD123 in B-cell acute lymphoblastic leukemia, 42 samples from adult and pediatric ALL patients were analyzed, including 14 subjects enrolled in our current CTL019 clinical trials. As shown in FIGS. 49A, 49B and 49A, CD123 is highly and homogeneously expressed on the surface of most ALL blasts, representing an ideal candidate for targeted therapy. Moreover, CD123 is also found to be expressed in the putative leukemia stem cells (LSC), identified as CD34+CD38− (FIG. 49C). Small subsets of CD19-negative blasts can be identified in some B-ALL patients and these cells could contribute to antigen-loss relapses, if they contained cells with a malignant phenotype. In order to evaluate the presence of disease in CD19-negative subsets, CD19− CD123+ cells from a Philadelphia chromosome positive B-ALL bulk population were sorted (CD45dim, gating strategy shown FIG. 56B). It was found that these cells were clonal for the BCR-ABL translocation, albeit at a lower frequency than the CD19+ blasts (FIG. 49D). This finding indicates that targeting CD19 alone could, in some cases, lead to a subclonal relapse derived from CD19−CD123+ cells. Furthermore, this finding suggests that targeting CD123 could lead to deeper responses through the elimination of the LSC and possibly CD19-neg leukemia clones.

Figure 49E:
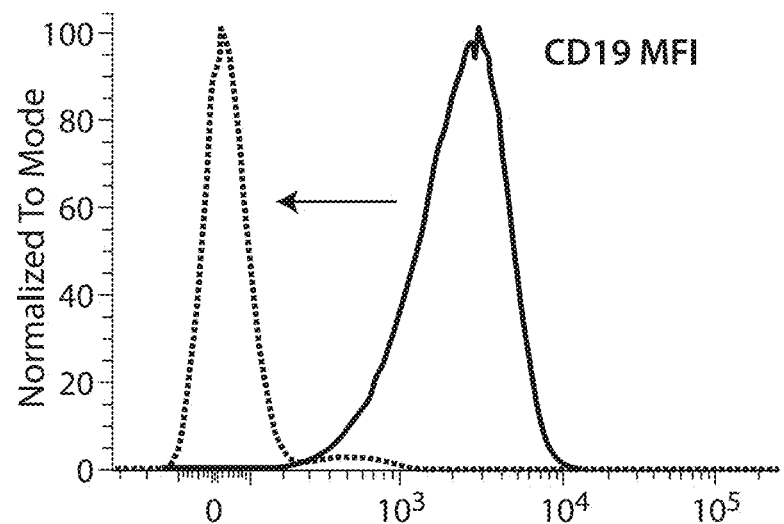
Figure 49E:
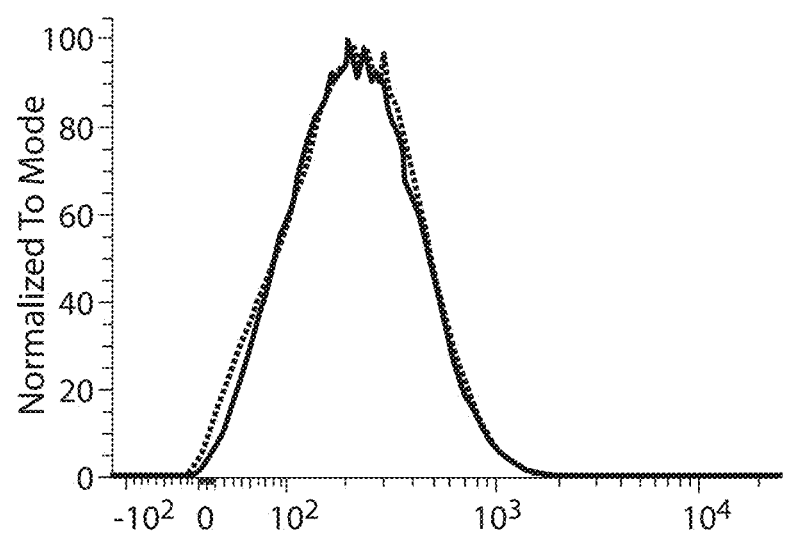
Figure 49F:
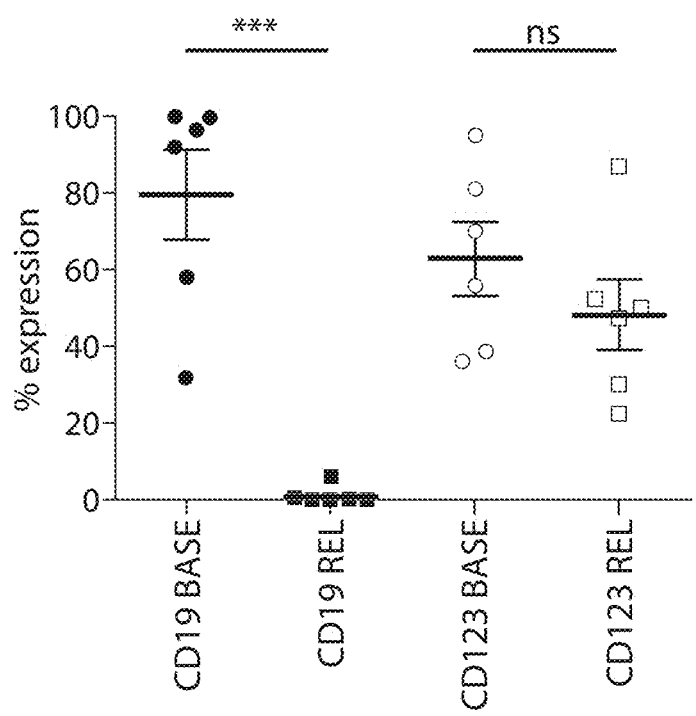
Figure 56A:
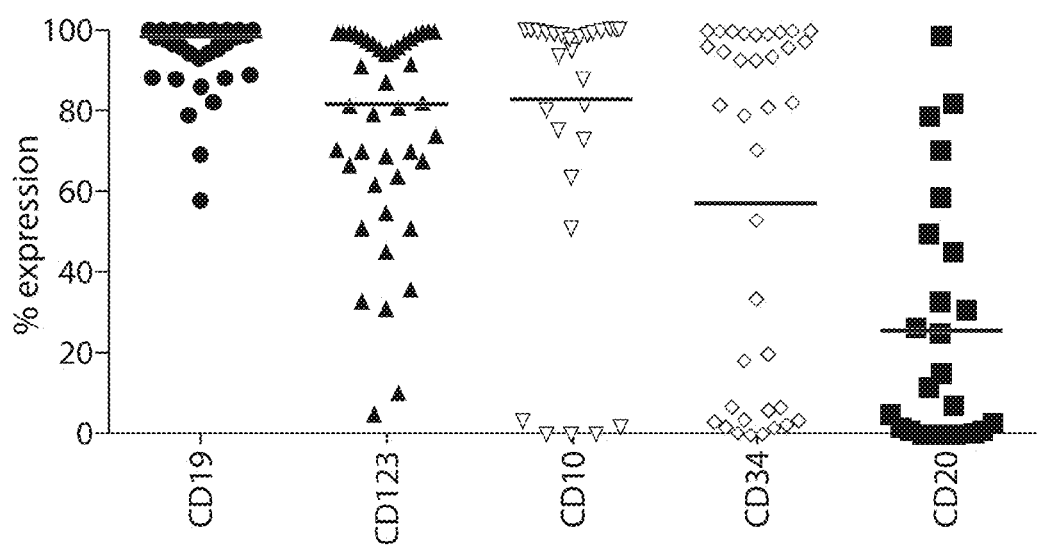
FIGS. 56A and 56B show characterization of ALL blasts.
Figure 56B:
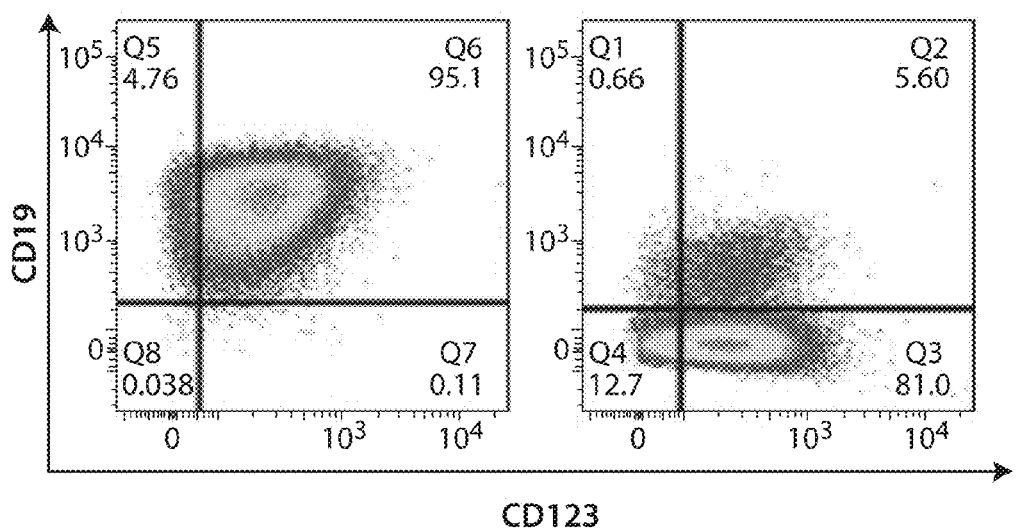
Figure 56B:
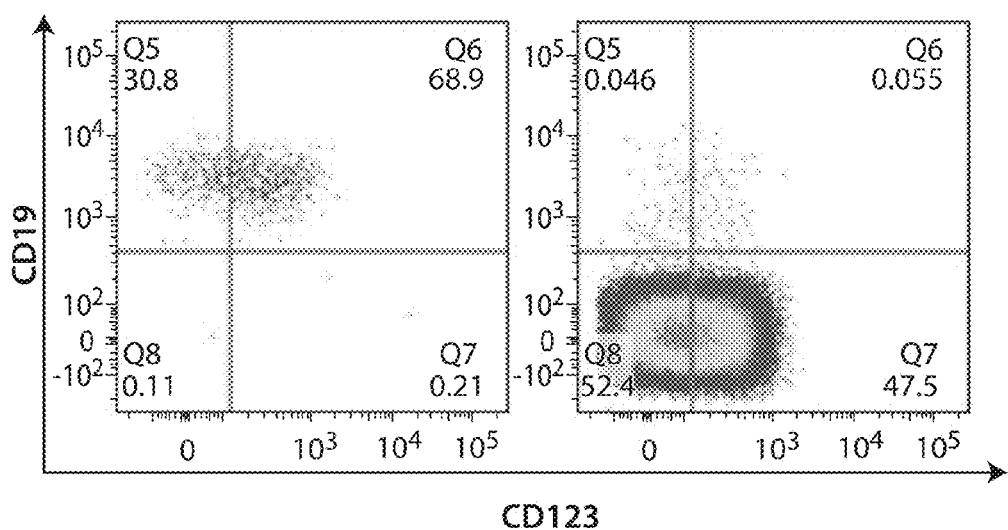

Finally the expression of CD123 was also evaluated in the samples of B-ALL patients relapsing after CTL019 with loss of CD19. Importantly, in contrast to the complete loss of CD19, the majority of patients maintained CD123 expression at relapse (FIGS. 49E, 49F and 56C). These findings indicate that CD123 represents an ideal marker to target CD19-neg ALL blasts occurring after CART19 or blinatumomab.

Anti-CD123 Chimeric Antigen Receptor T Cells are Active Against Human B-ALL In Vitro and In Vivo Anti-CD123 chimeric antigen receptor T cells (CART123) were generated that were lentivirally transduced and expanded with anti-CD3/CD28 magnetic beads. The in vitro and in vivo activity of CART123 against B-acute lymphoblastic leukemia were evaluated as described herein.

Figure 50A:
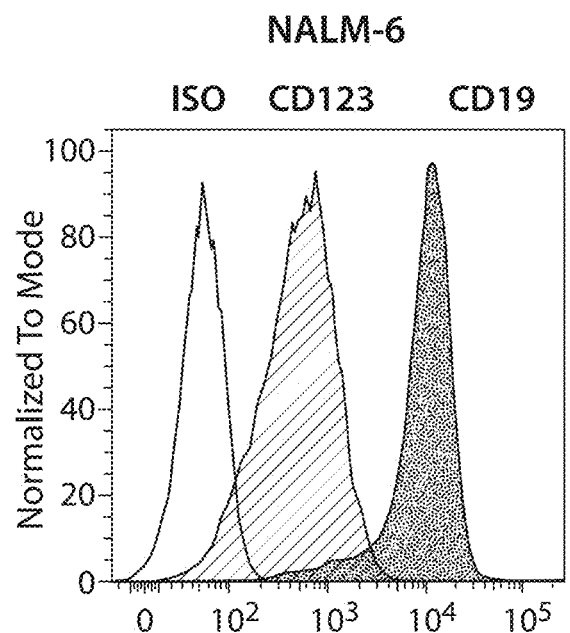
FIGS. 50A, 50B, 50C, 50D, 50E, and 50F shows results from various in vitro assays using T cells expressing a CD19 CAR (CAR19) or a CD123 CAR (CAR123).
Figure 50B:
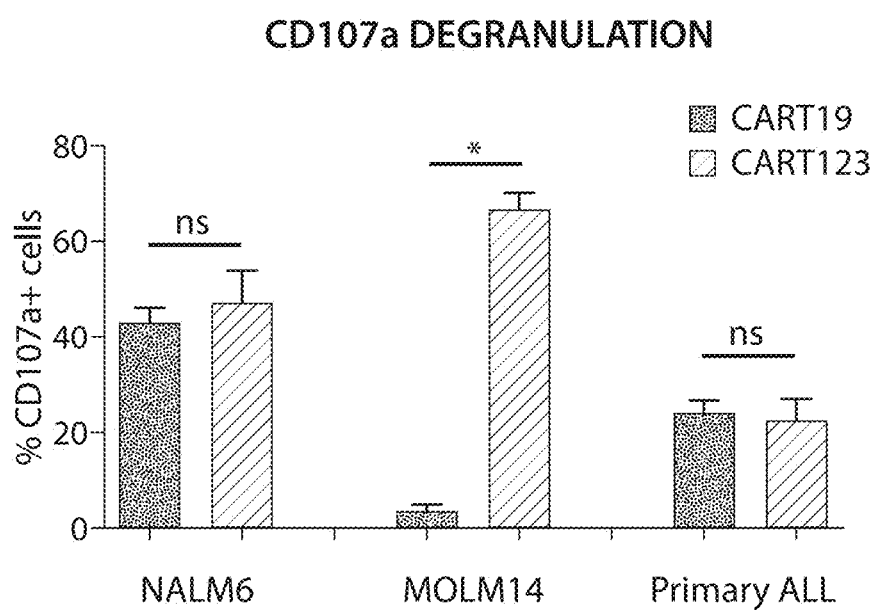
Figure 50C:
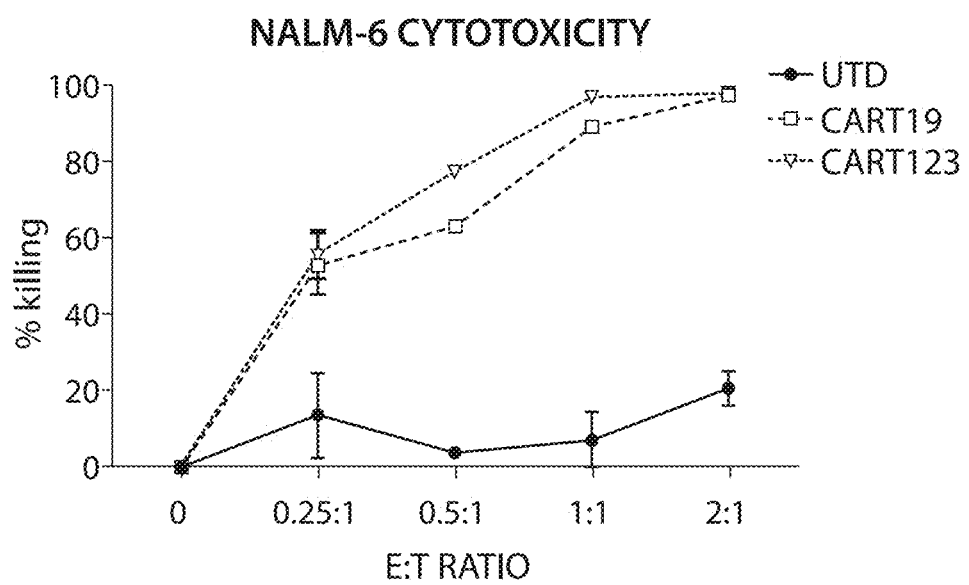
Figure 50D:
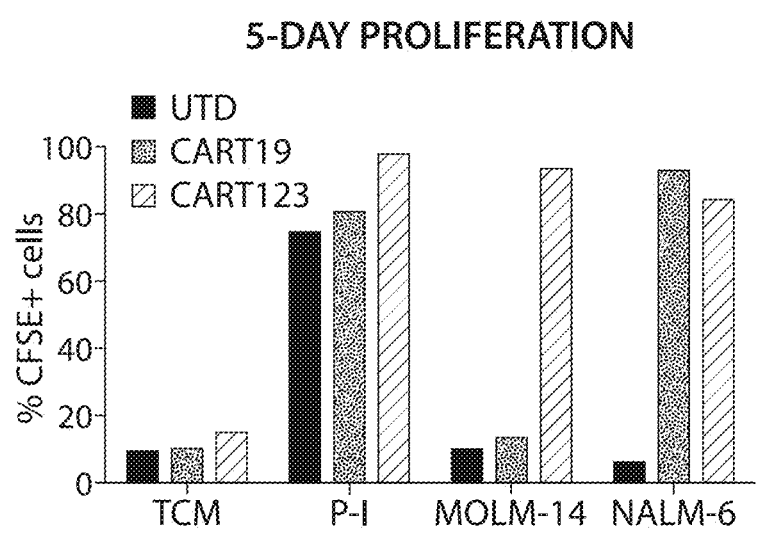
Figure 50E:
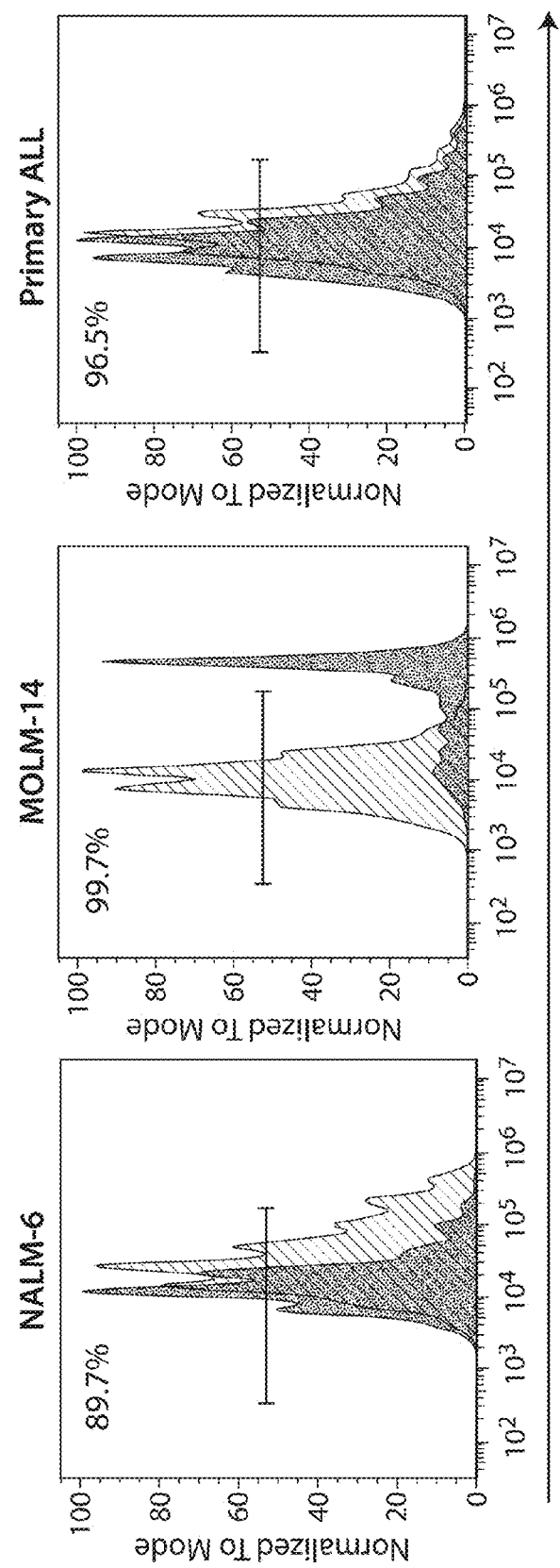
Figure 50F:
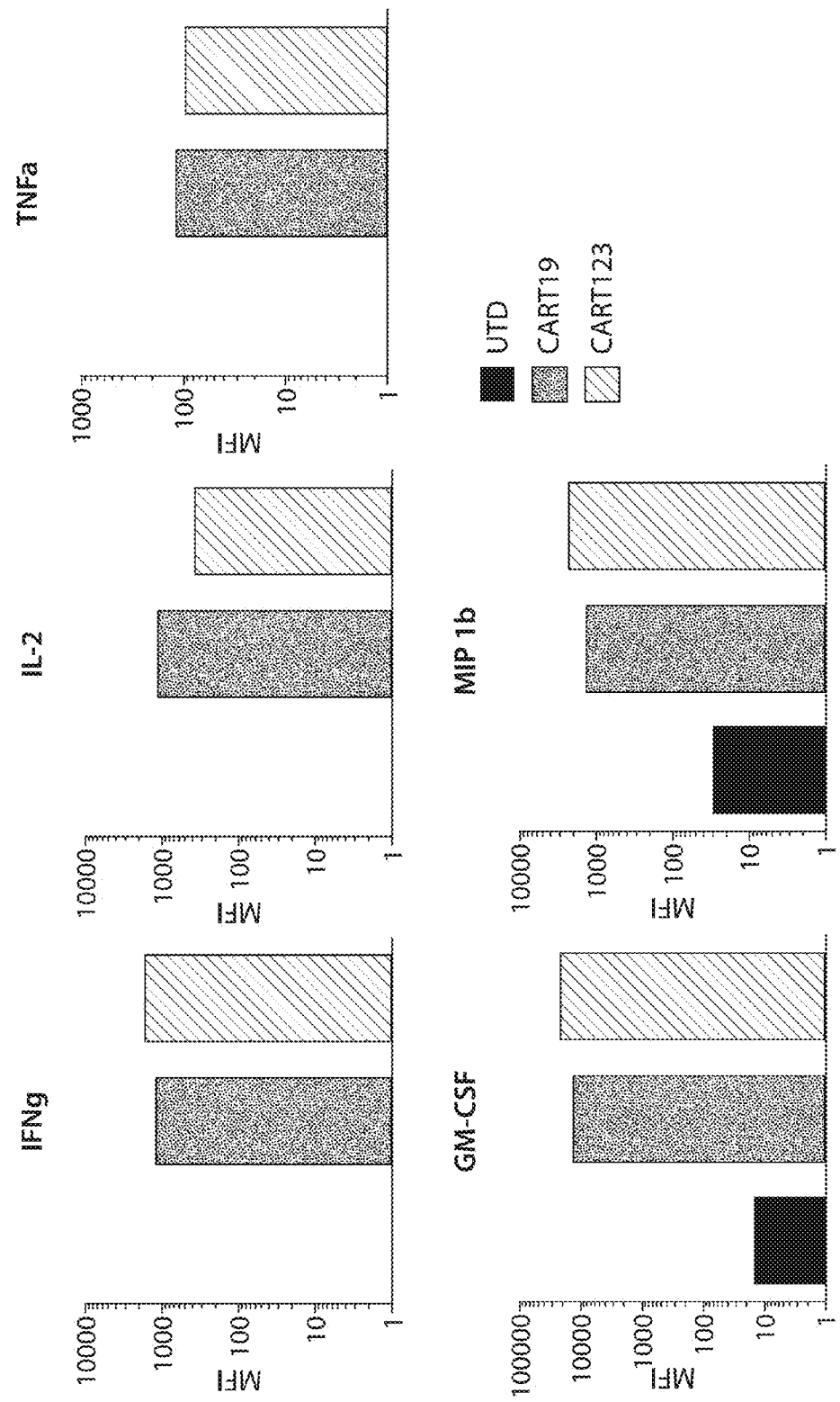
Figure 57A:
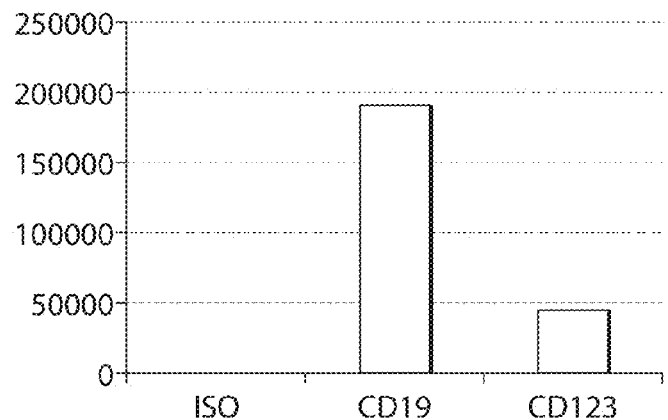
FIGS. 57A, 57B, 57C, and 57D show anti-leukemia activity of CART123.

The B-ALL cell line NALM-6 that is CD19++ and CD123+ (FIGS. 50A and 57A) and primary B-ALL samples were used. A head-to-head in vitro comparison between CART123 and CART19 revealed similar rates of CD107a degranulation when T cells were co-cultured with NALM-6 or primary ALL (FIG. 50B). CART123 were also able to kill NALM-6 cells with similar efficacy as CART19 in a dose-dependent manner (FIG. 50C). At more long-term experiments, CART123 proliferated (FIGS. 50D and 50E) and produced multiple cytokines (FIG. 50F) when co-cultured with NALM-6 or primary ALL for 3-5 days. These results indicate that CART123 exhibit equivalent potency to CART-19 against multiple B-ALL targets.

Figure 51A:
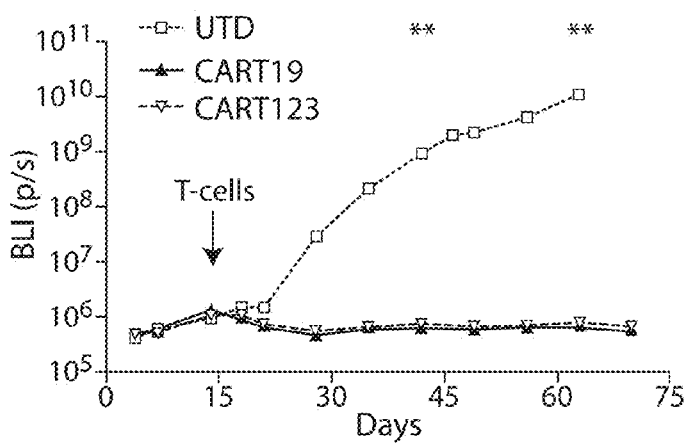
FIGS. 51A, 51B, and 51C show that CART cells expressing CD19 CAR (CAR19) or CD123 CAR (CAR123) had an anti-tumor effect in an in vivo mouse model.
Figure 51B:
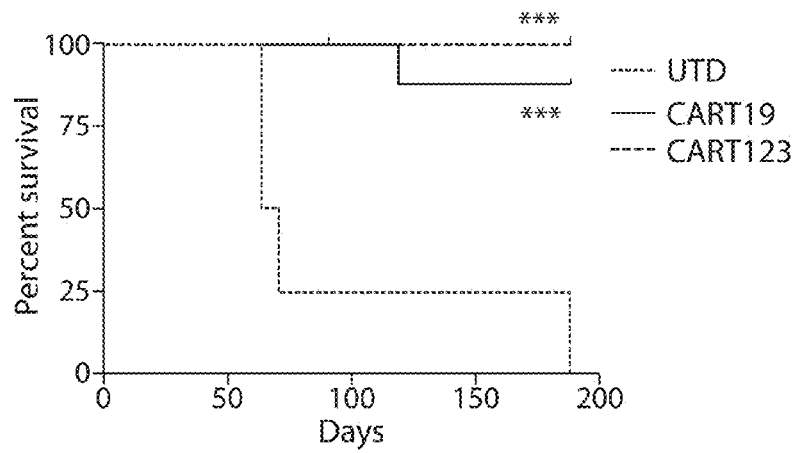
Figure 51C:
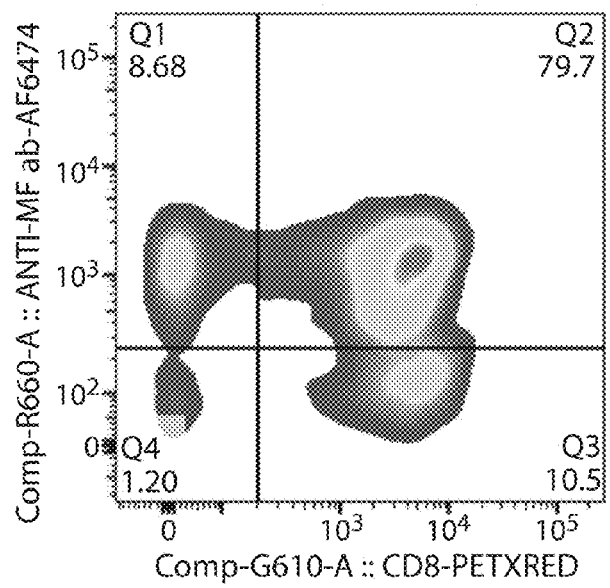
Figure 57B:
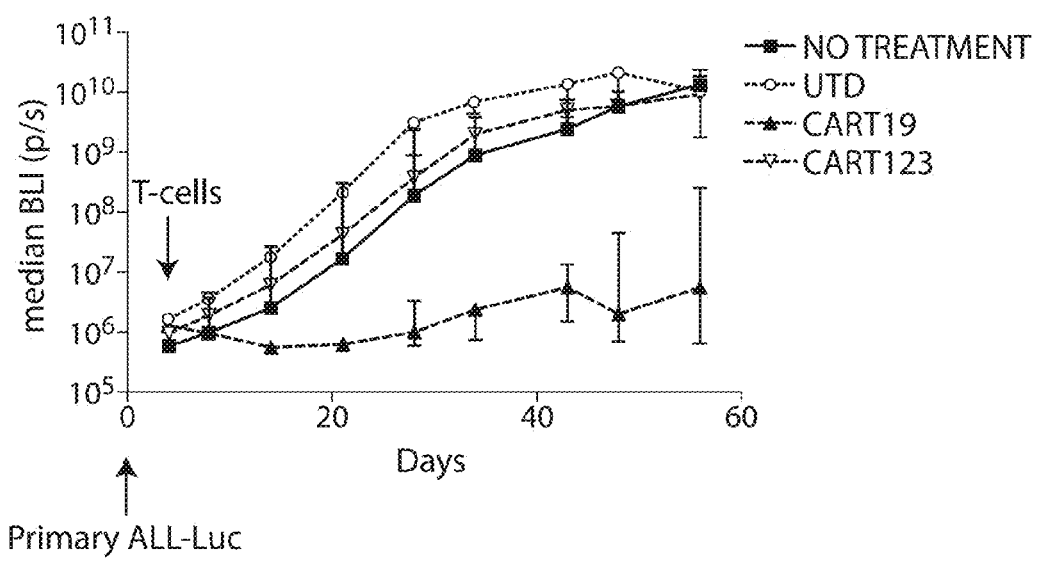
Figure 57C:
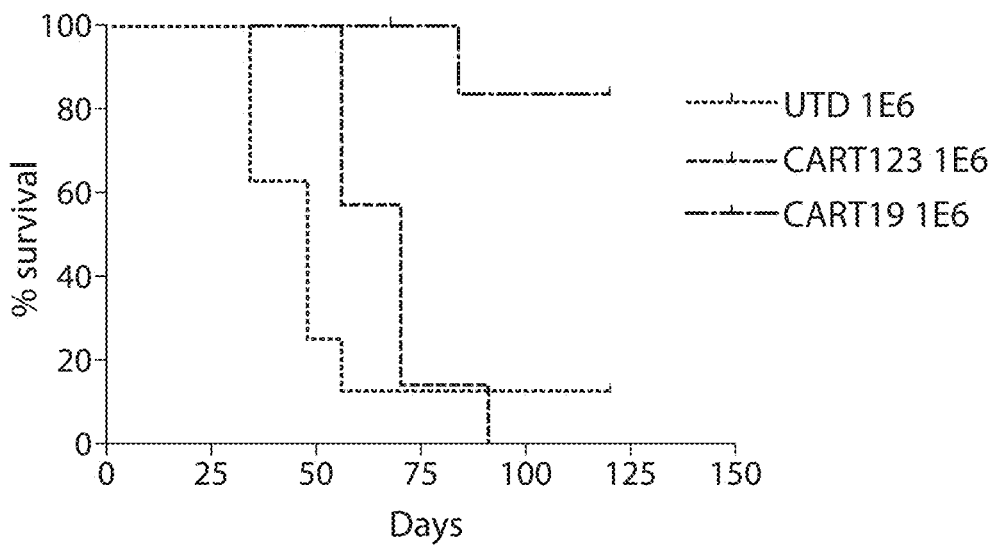

In order to confirm these data in an in vivo model, a primary ALL model was utilized. In this model, primary blasts obtained from B-ALL patients were passaged in NOD-SCID-γ chain knock-out (NSG) mice and transduced with a reporter construct containing eGFP and click beetle luciferase (GFP/Luc). NSG mice were injected with GFP/Luc+ primary ALL blasts i.v. (JH331, CD19+, CD123+, add phenotype) and after engraftment, mice were randomized to receive CART19, CART123 or control untransduced T cells (UTD). Mice treated with control T cells succumbed quickly to disease, while mice treated with either CART19 or CART123 showed tumor eradication and long term survival (FIGS. 51A and 51B). CAR123 T cells significantly expanded in the peripheral blood (PB) of the mice compared to control T cells and expressed high levels of CAR123 (FIG. 51C). The anti-leukemia activity of CART123 was specific and based on the recognition of CD123 in the surface of the blasts as when we engrafted mice with a CD123− CD19+ leukemia (AV576), only CART19 show anti-leukemia activity, while CART123 had no effect as compared to controls UTD (FIGS. 57B and 57C).

Figure 57D:
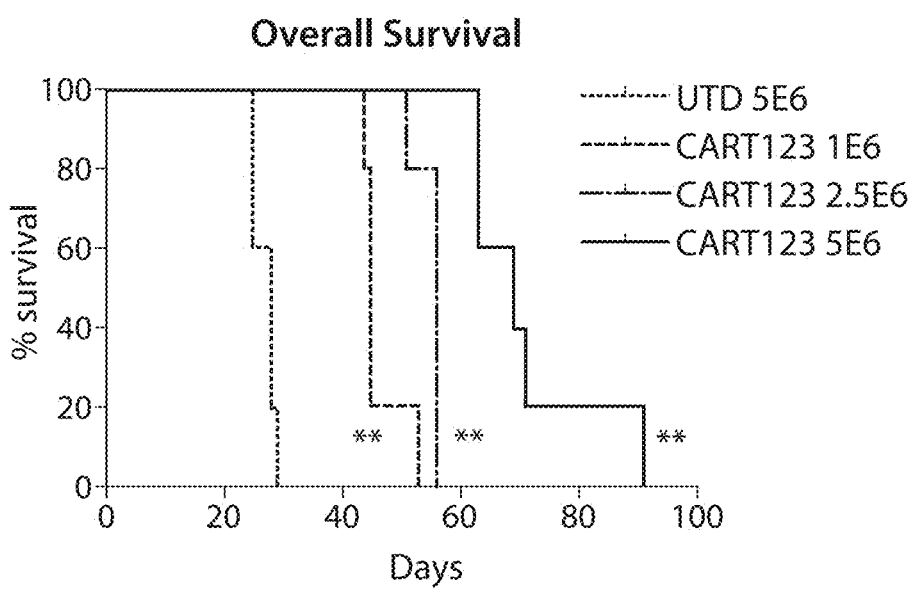

In order to detect a possible correlation of CART123 dose and anti-tumor activity, an in vivo model of high leukemia burden bearing mice (using the NALM-6 cell line) was developed. In this model standard doses of CART123 (2 million CAR+ cells) are not able to clear the tumor. These mice were injected with different doses of CART123 (1.25, 2 and 5 million CAR+ cells) and observed a dose-related anti-leukemia activity (FIG. 57D).

Figure 52A:
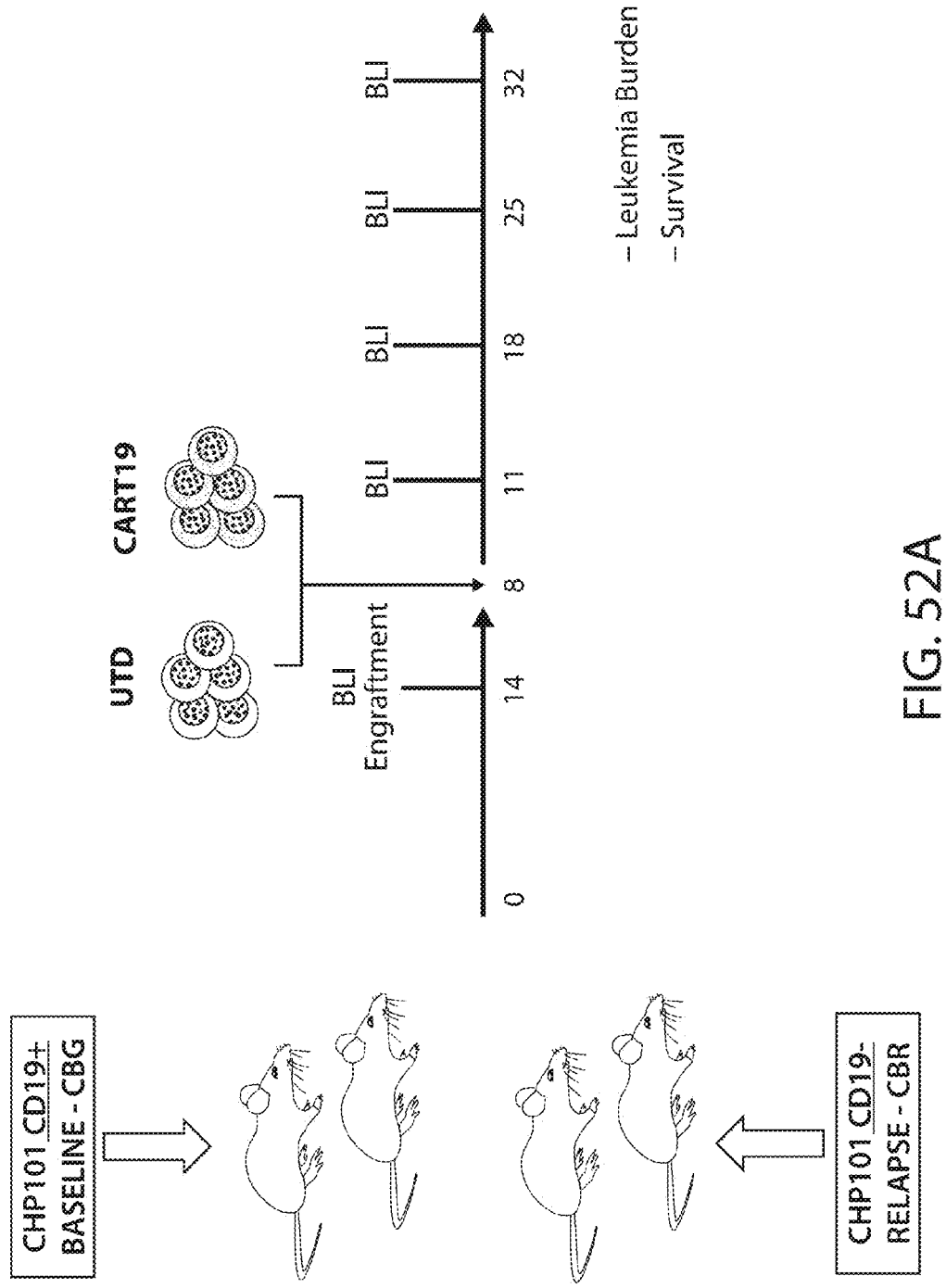
FIGS. 52A, 52B, 52C, 52D, 52E, and 52F show that CART123 is active in an in vivo mouse model of antigen-loss relapse.
Figure 52B:
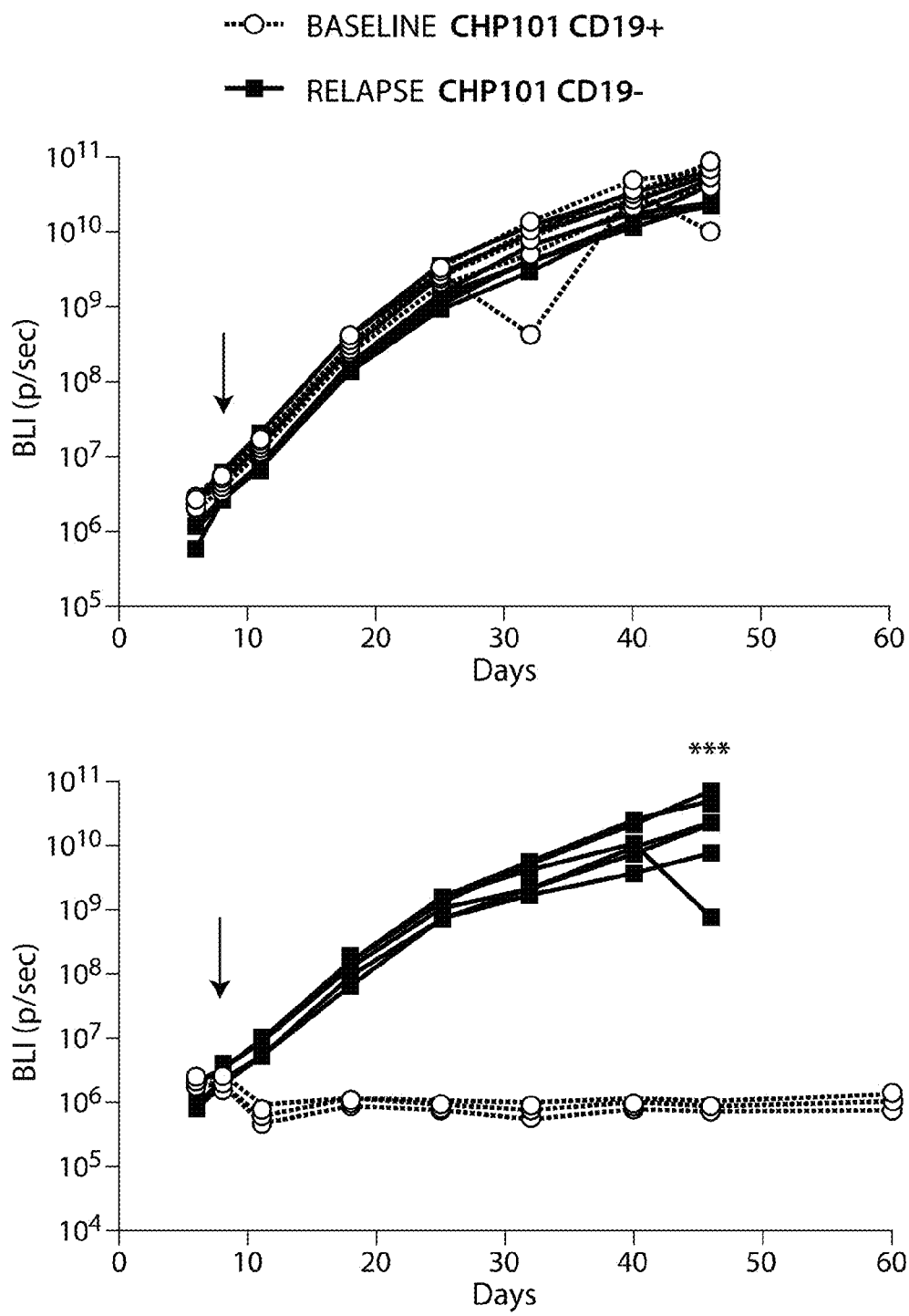
Figure 52C:
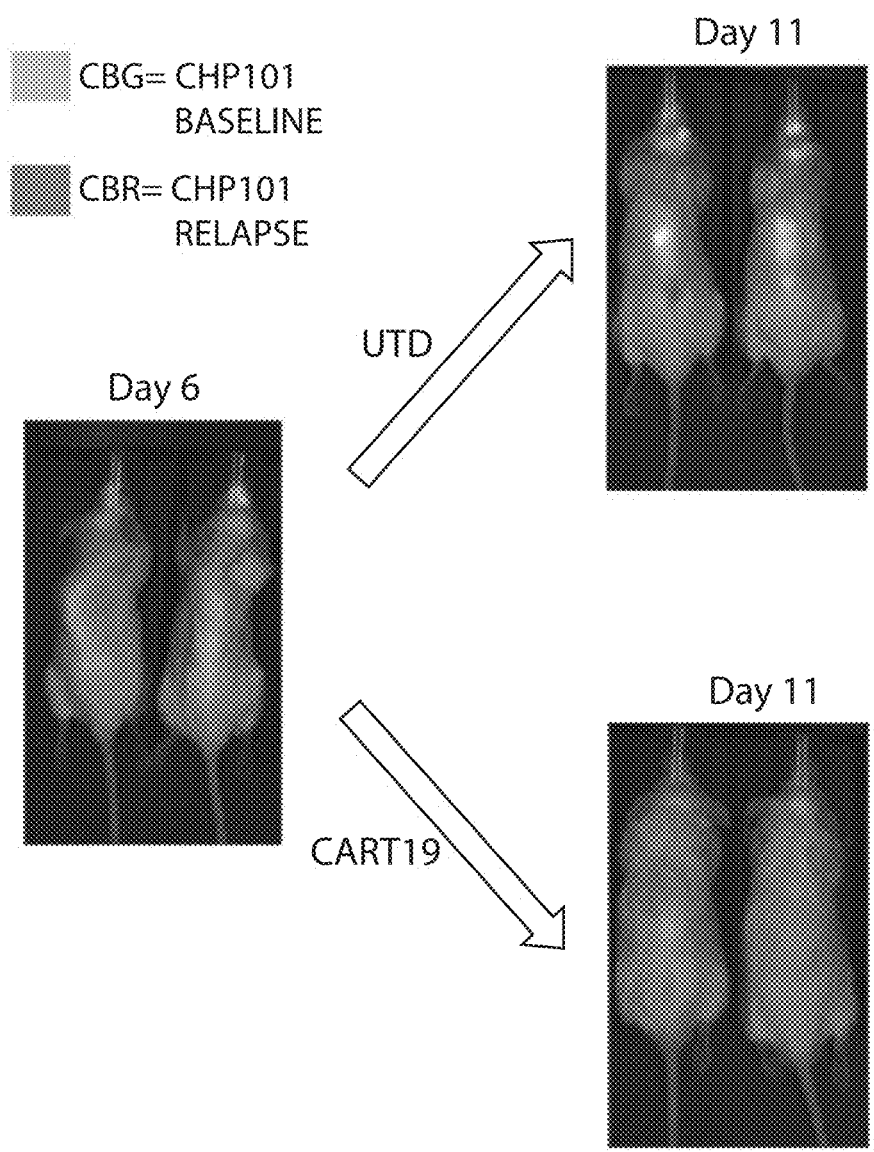
Figure 58A:
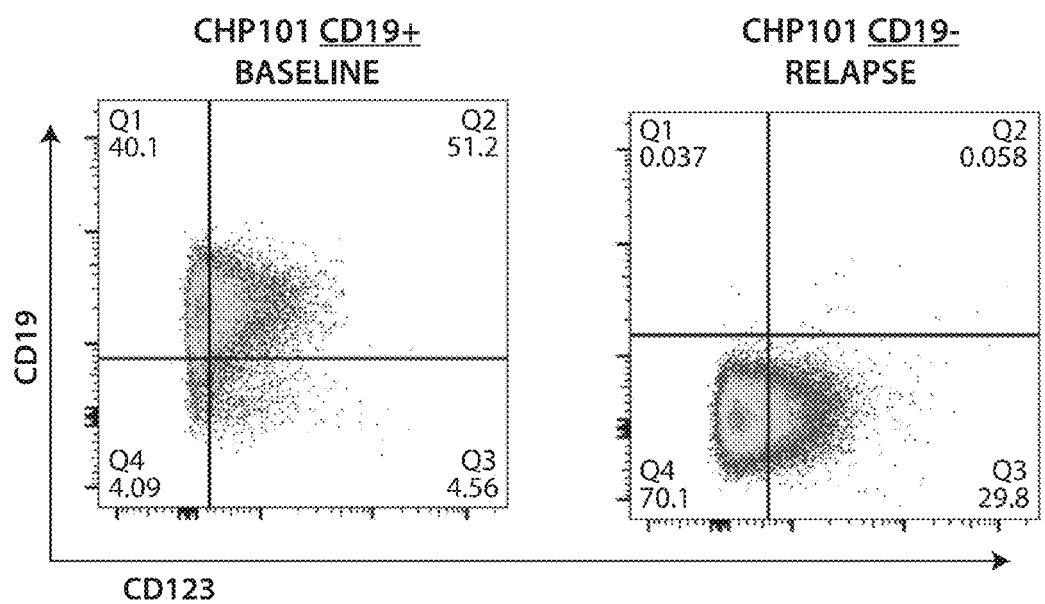
FIGS. 58A and 58B show the characterization of the in vivo model of antigen-loss relapse.
Figure 58B:
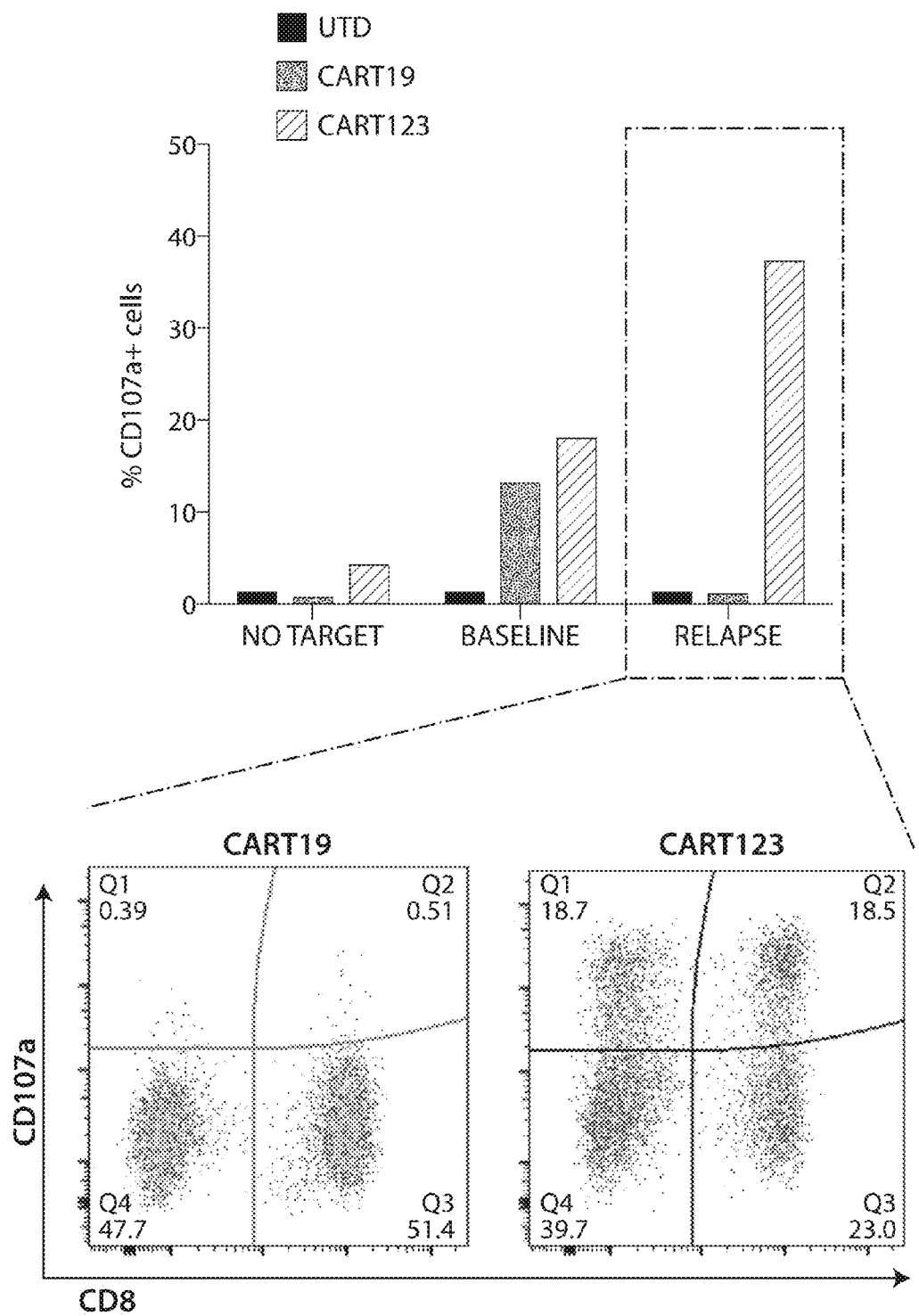

CART123 but not CART19 are Highly Active in a Novel Preclinical Model of Antigen-Loss Relapse In order to test new strategies to target CD19-negative relapses a novel in vivo model of antigen-loss relapse was developed. B cell blasts obtained from a patient (CHP101) enrolled in one of our CTL019 clinical trials were collected at baseline (before CTL019 therapy), when the disease was CD19++ and CD123+, and at relapse after CTL019 when the patient developed a CD19-negative disease (CD123 still expressed, FIG. 58A). Blasts were then expanded in NSG mice and transduced with click-beetle green luciferase (CBG) for baseline disease (CD19+) or click-beetle red luciferase (CBR) for relapse (CD19−) (see Methods section). Importantly, during in vivo expansion, the blasts retained markers of B cell identity other than CD19 (data not shown). In a first experiment NSG mice were engrafted with either the baseline disease CD19+ (CBG, green) or the CD19-neg (CBR, red) leukemia. Both groups were randomized to receive CART19 or control T cells (UTD) (FIG. 52A). As shown in FIG. 52B, in both groups mice treated with UTD showed rapid progression of both the baseline and relapse disease, independently by the expression of CD19. Conversely, in the group of mice treated with CART19, only mice engrafted with the baseline disease (CD19-positive) responded to CART19 treatment while mice engrafted with the relapsed disease (CD19-negative) showed refractoriness as expected. This was also reproduced in vitro in a CD107a degranulation assay (FIG. 58B). In order to simulate in vivo the presence of different clones expressing CD19 or lacking it, NSG mice were engrafted with a 1:1 mixture of baseline and relapse disease; at day 8 mice were randomized to receive CART19 or control T cells. Tumor burden was monitored with bioluminescence imaging that could discriminate between CD19+ (CBG, green)/CD19− (CBR, red) leukemia relative growth in vivo. As shown in FIG. 52C, in mice receiving UTD both CD19+ (green) and CD19− (red) leukemia present at day 6 was similarly increased at day 11, while in mice treated with CART19 the baseline disease (green) was completely cleared while the relapsed disease (red) showed progression.

Figure 52D:
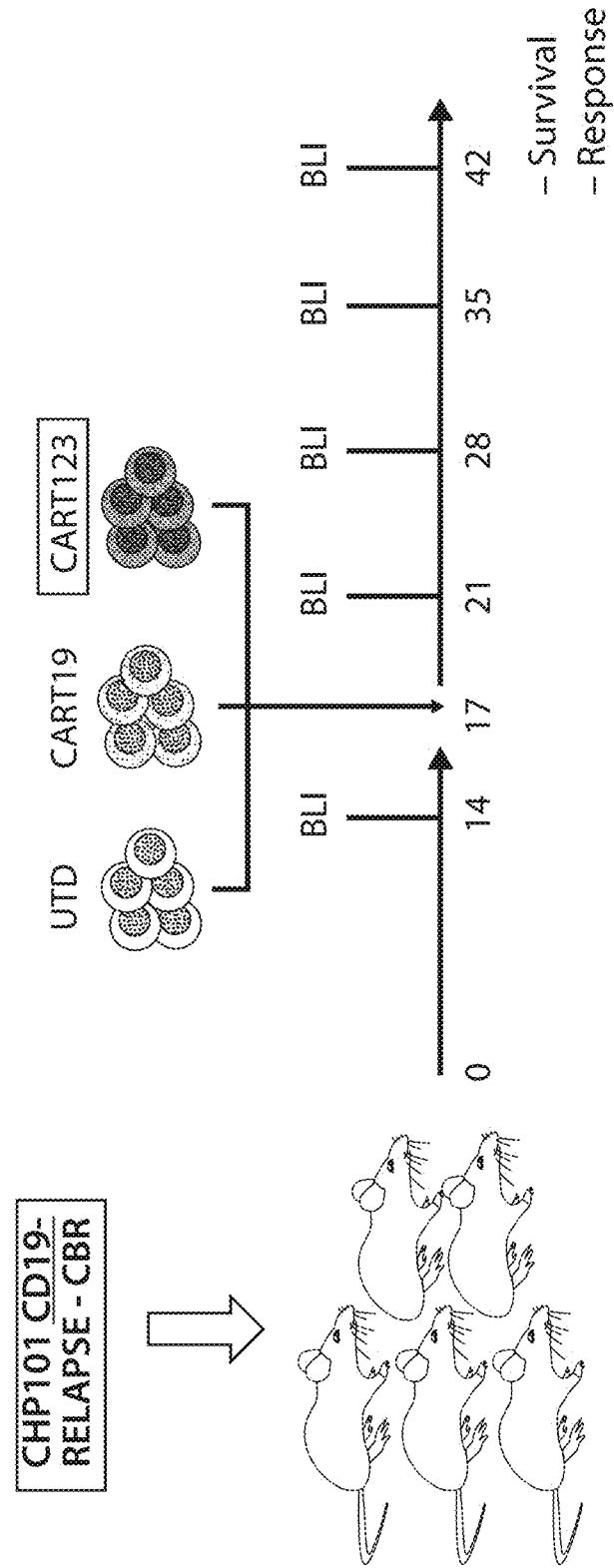
Figure 52E:
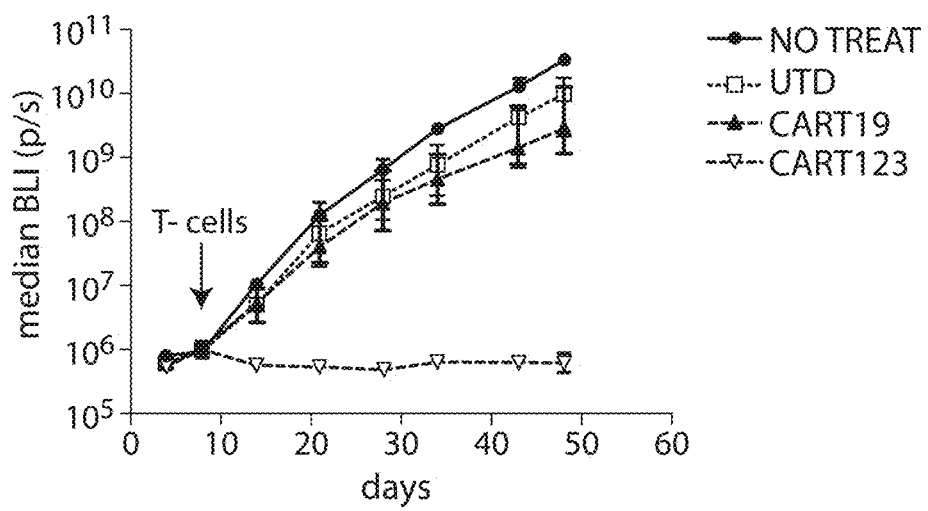
Figure 52F:
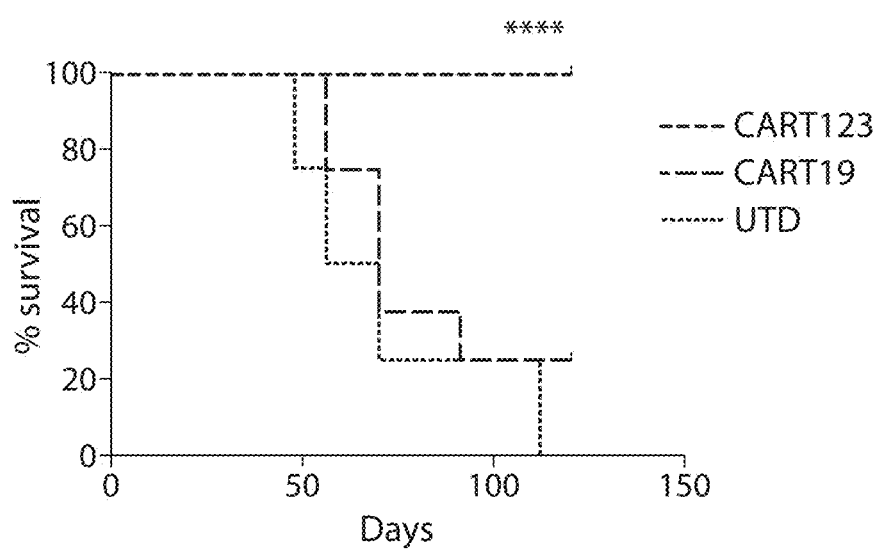

This unique xenograft model of primary CD19-negative B-ALL and CART19 failure was used to evaluate the role of CART123 in the treatment of antigen-loss relapses. Primary CD19-negative blasts (CBR positive) were injected into NSG mice (FIG. 52D) and mice were randomized to receive CART19, CART123 or control T cells. CART19 and control T cells showed complete lack of anti-tumor activity, while CART123 lead to complete eradication of the disease and long term survival in these mice (FIGS. 52E and 52F). Indeed in a pre-clinical model of primary B-ALL refractory to CART19, the novel CART123 are able to eradicate the disease and confer long-term survival.

Figure 53A:
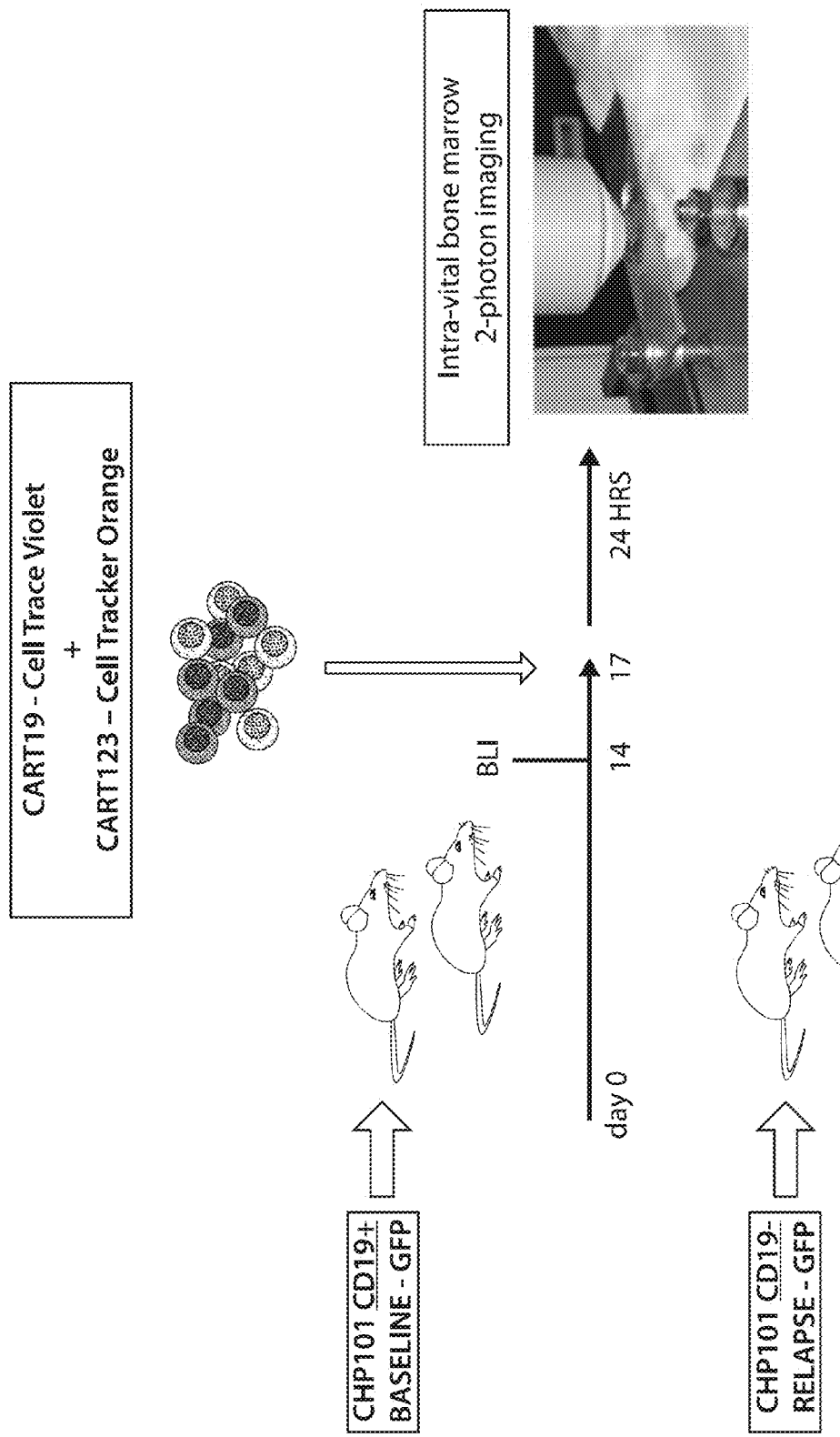
FIGS. 53A, 53B, and 53C show ALL-CART interactions in skull bone marrow of xenograft mice.
Figure 53B:
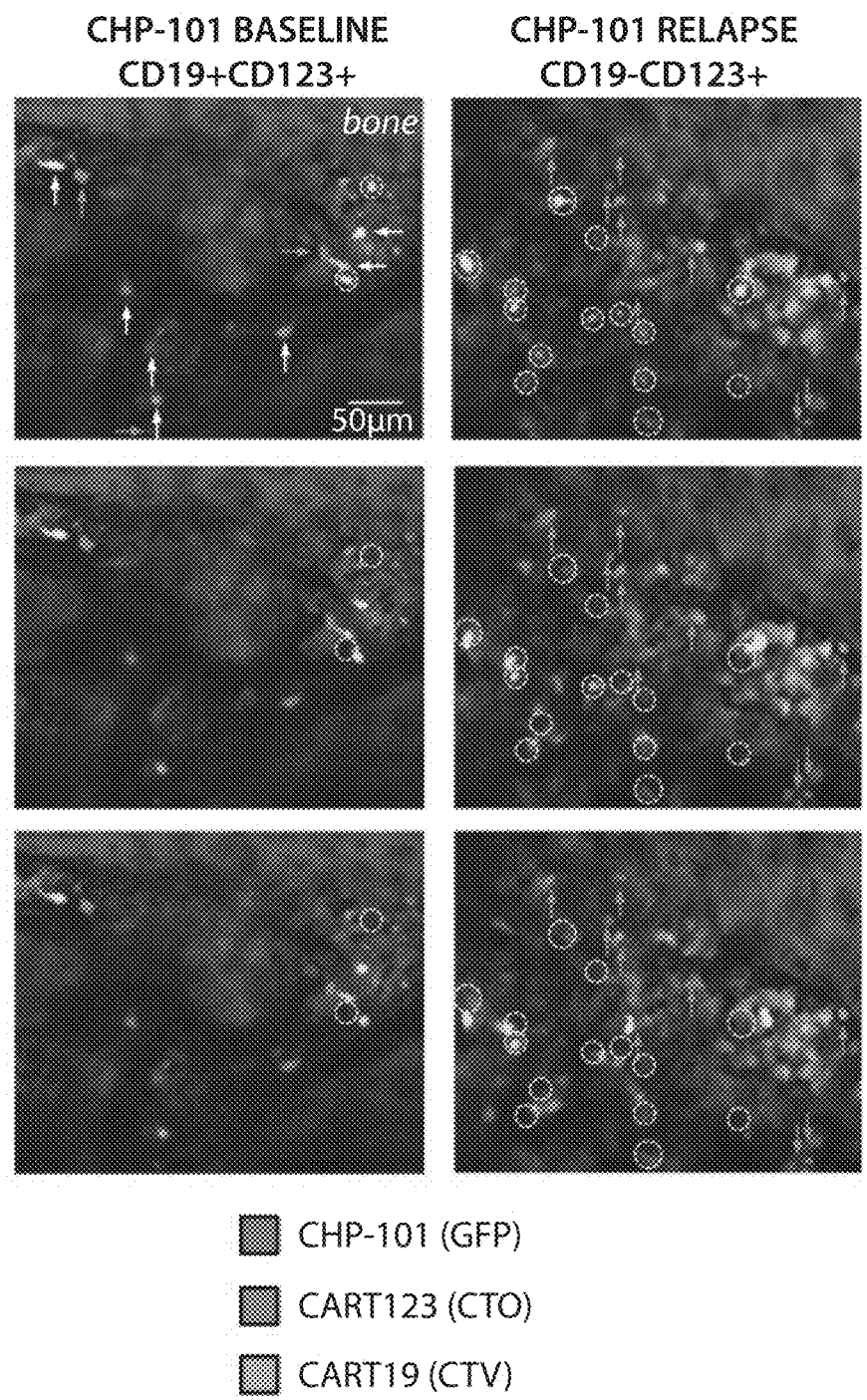
Figure 53C:
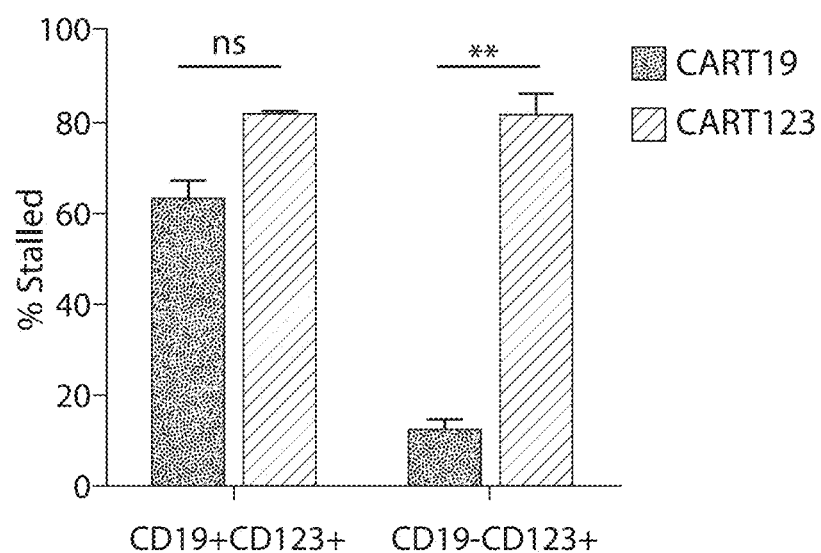

In order to understand the differential behavior of CART19 and CART123 in this in vivo model at a single cell level, a series of experiments was performed by injecting a mixture of differentially labelled CART19 (CellTrace Violet, blue) and CART123 (CellTracker Orange or TRITC, red) to mice bearing CD19-positive primary blasts (GFP) or CD19-negative relapsed blasts (GFP) and tracked their behavior using intravital 2-photon microscopy of calvarial marrow approximately 24 hours after injection (experiment schema, FIG. 53A). These studies showed that CART19 and CART123 trafficked to marrow spaces containing leukemia and that CART cell recognition of cognate antigen correlate with motility arrest. Specifically, in mice engrafted with the baseline CD19+CD123+ leukemia, 62.9%+/−3.8 of CART19 and 81.1%+/−1.2 of CART123 were found to be stalled with a rounded morphology adjacent to blasts, whereas in mice engrafted with the relapsed CD19-CD123+ leukemia, only CART123 cells arrested next to tumor cells (CART123 80.9%+/−5.1 vs CART19 12.4%+/−2.2) (FIGS. 53B and 53C). These findings indicate that in CD19-negative relapsed ALL only CART123 were able to establish productive synapses with the leukemia cells (GFP) and thus reduced their motility, whereas CART19 cells continued sampling and moving in the environment without recognizing the leukemia blasts.

The Combination of CART123 and CART19 is Able to Prevent CD19-Negative Relapses

Figure 54A:
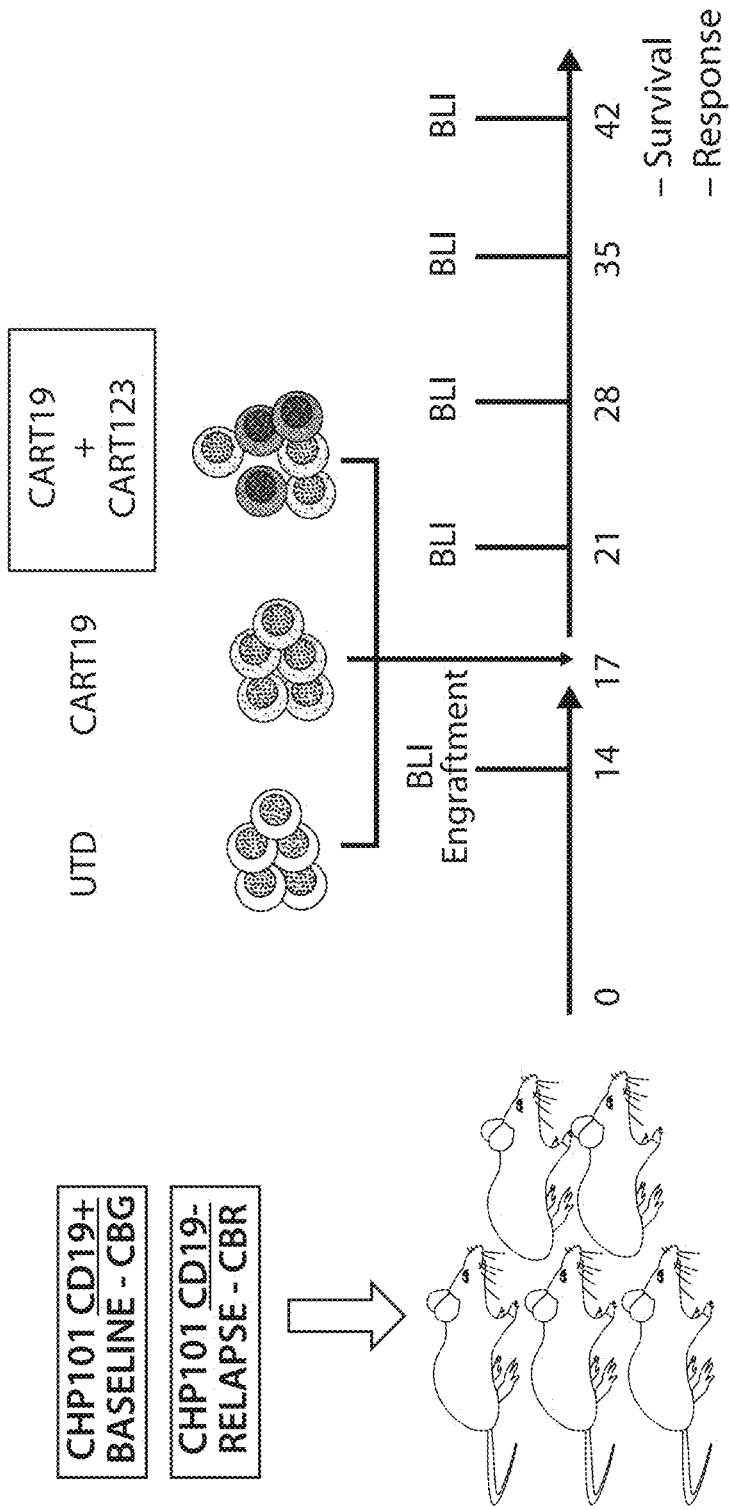
FIGS. 54A, 54B, and 54C show the prevention of CD19-neg relapses using CART19 and CART123.
Figure 54B:
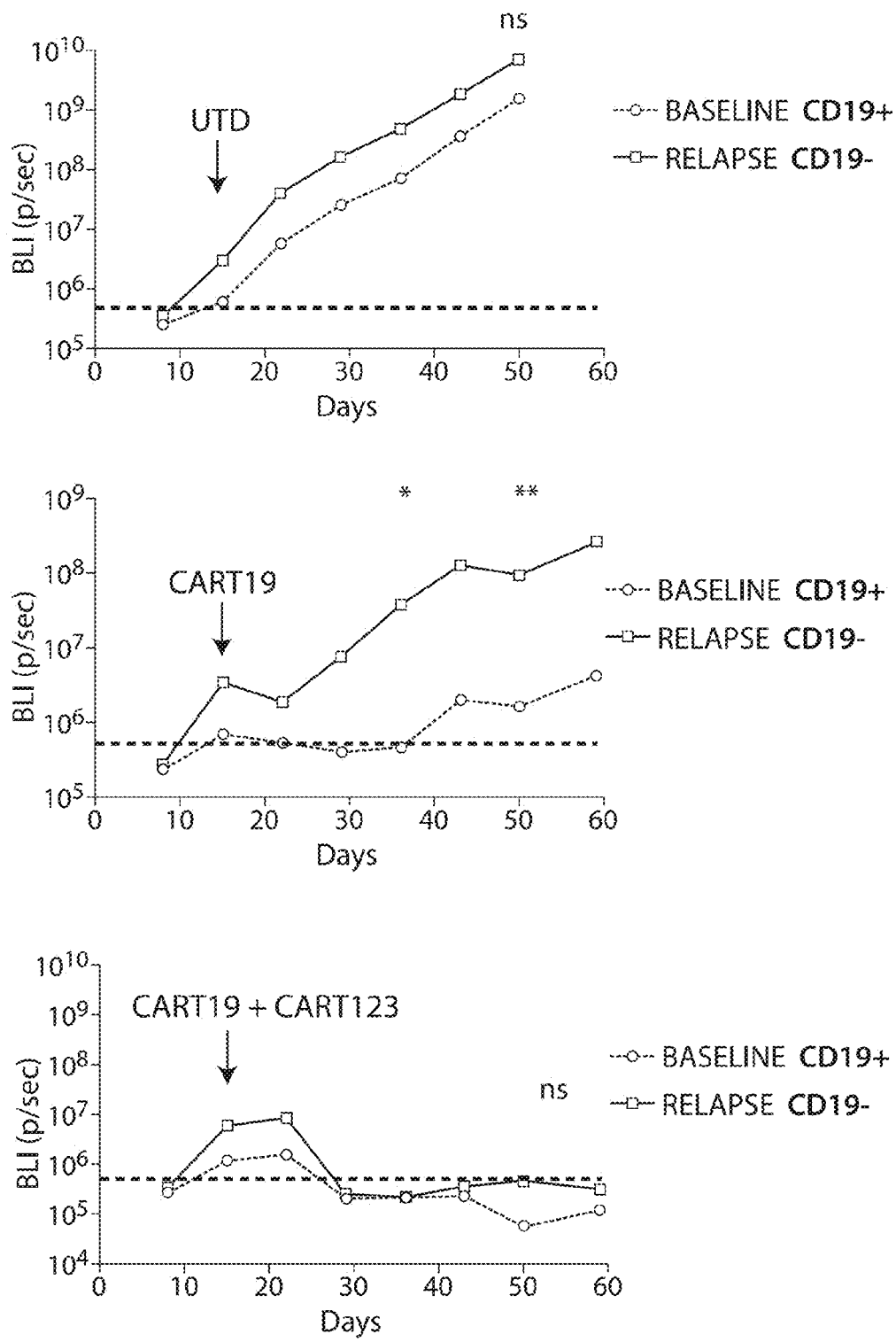
Figure 54C:
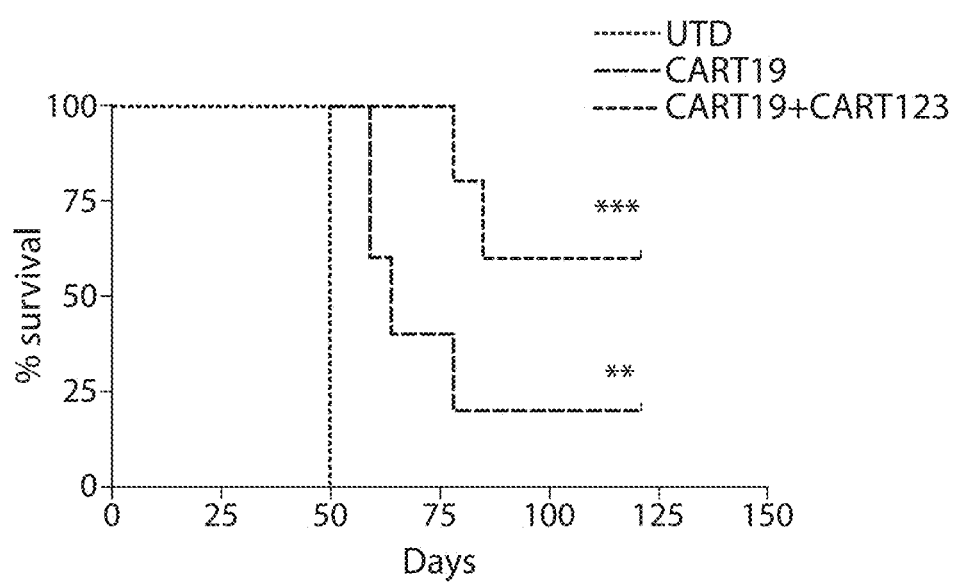

CART123 proved to be effective in the treatment of CD19-negative relapses occurring after CD19-directed therapies in a preclinical model of CART19 resistance. However, a combinatorial approach could treat active CD19-positive disease while simultaneously preventing antigen-loss relapses. In order to test this hypothesis the emerging clinical problem of B-ALL with a potential for CD19-negative escape was modeled by injecting primary CD19− and CD19+ disease together into NSG mice. Mice were then randomized to receive control T cells (UTD), CART19 or the combination of CART19 and CART123, with the same total dose of T cells (FIG. 54A). As shown in FIG. 54B, mice treated with control T cells had progression of both leukemia clones and CART19 showed rapid progression mostly of the CD19-neg disease (red). On the contrary mice treated with the combination of CART123 and CART19 showed clearance of the disease and improved overall survival, as shown in FIG. 54C. Analysis of mice sacrificed at the end of the experiment showed no evidence of residual leukemia in the pooled CAR T cell group. In contrast, mice with progressive disease after CART19 monotherapy retained the expected CD19 negative phenotype (FIG. 54D).

Figure 55A:
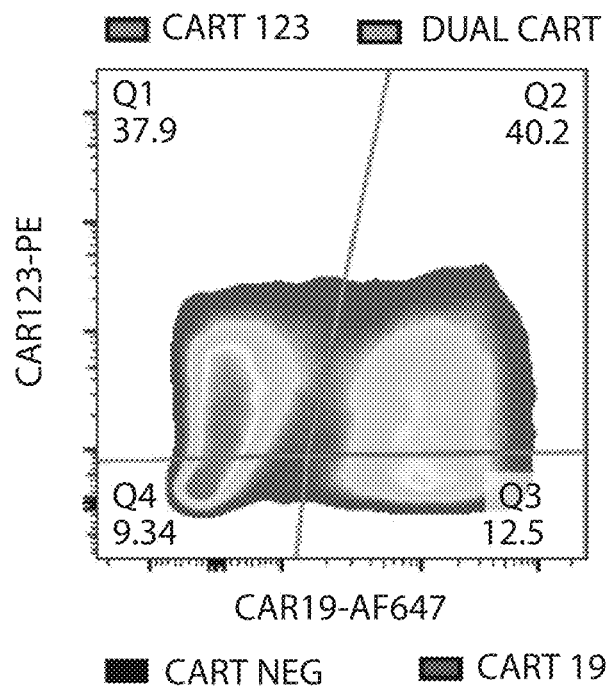
FIGS. 55A and 55B, show T cells expressing both CAR19 and CAR123 (FIG. 55A) and the results from a degranulation assay (FIG. 55B).
Figure 55B:
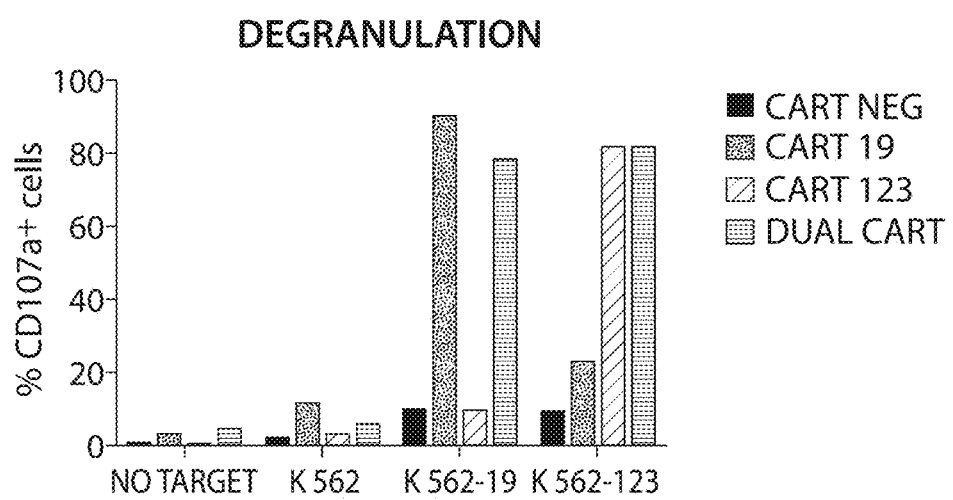

Lastly, T cells were transduced with 2 lentiviruses, one carrying CAR19 and the other CAR123 in order to develop a CART able to be activated by both CD19 and/or CD123. As shown in FIG. 55A, four differently transduced T cell subsets were detected: CAR19 and CAR123 double negative, CAR19 single positive, CAR123 single positive and double positive CAR19/CAR123 T cells. These four subsets were sorted and their functionality and specificity was tested against K562-WT, K562 CD19+ or K562 CD123+. FIG. 55B shows the results of a CD107a degranulation assay where the single positive subsets respond to their specific target while only the double positive population is able to degranulate in the presence of both CD19 and CD123 expressing K562. In addition, dually-stimulated CART cells exhibited more potent cytotoxicity against a double-positive target in comparison with an equivalent number of single-stimulated CART cells, suggesting a potential increment in efficacy by using a CAR that is triggered by two different antigens (FIG. 55C).

Discussion

CD19 directed immunotherapies are changing the paradigm of treatment of relapsing and refractory acute lymphoblastic leukemia. Patients with a previously dismal outcome now have a realistic potential to achieve a complete response and long-term disease remission. However, as shown under some circumstances for leukemia treated with other forms of potent targeted therapy, leukemia cells are able to develop antigen-loss mutations that lead to resistance and relapse. In the case of CART19, two main patterns of relapses have been observed. Patients with early loss of CART19 through failure of persistence are at risk for relapse of the original clone; indeed, minimal residual disease analyses indicate that between 1-6 months of sustained CART activity may be required to completely eradicate malignancy. In contrast, around 50% of relapses occur despite CART19 persistence and are characterized by the occurrence of aCD19-negative leukemia. The latter observation implicates potent selective pressure by CART19. Notably, CD19-negative relapses have also occurred after blinatumomab therapy although these represent the minority of relapse occurrences after this arguably less potent therapy. There are multiple potential mechanisms for the development of CD19-negative disease. One of these is the selection and relative survival advantage of CD19-negative clones that were present at baseline in very low frequency, and this was initially considered the most likely factor leading to CD19-negative relapses. More recently other mechanisms, such the dysregulation of the splicing of CD19 have also been considered important. Here it is shown for the first time that rare CD19-ve blasts in B-ALL can contain the hallmark cytogenetic abnormalities found in the more common CD19-positive leukemia blasts, confirming this as a potential mechanism of CD19-negative relapse. We confirmed these findings by demonstrating that CD123+CD19-ve blasts can engraft in immunodeficient mice, indicating that CD123 may be a marker of leukemic stem cells in B-ALL as it is in AML.

The goal of this study was to define novel strategies to treat patients relapsing with antigen loss after CD19-directed therapies. CD123 was highly expressed in the majority of B-ALL, and in particular CD123 remains expressed in those relapsing with CD19-negative disease. It was demonstrated the presence of clonal leukemic cells in the CD19− CD123+ population indicating that targeting CD123 in combination with CART19 can increase the likelihood of eradicating sub-clones that could proliferate due to a selective advantage upon CART19 pressure. CD123 has previously been validated as a marker of the leukemic stem cell in AML. Here it was shown that CD123 to be expressed in the immunophenotypically-defined leukemic stem cell (LSC) in ALL, raising the possibility that targeting CD123 on LSC could promote ALL eradication.

To study the role of CART123 in antigen-loss relapses a novel xenograft model of CD19-negative relapses was developed from primary blasts derived from a B-ALL patient (CHP101) enrolled in one of the CTL019 trials of the University of Pennsylvania/Children's Hospital of Philadelphia. This patient, at baseline had a classic CD19+CD123+ phenotype but then relapsed after CART19 treatment with CD19-CD123+ disease. Using this model, it was demonstrated CART123 could eradicate the relapsed disease, and in combination with CART19 could prevent antigen-loss relapse. This is the first demonstration of a dual CART combination in a clinically relevant, patient-derived model. In addition, through use of intravital imaging, it was shown that CART cells enter the marrow in less than 24 hours after intravenous injection, search for their targets, and slowdown in order to interact with cognate antigen-bearing cells. Furthermore, it was shown that a dual signaling CART123/19 was more effective than either CART alone or a pool of both CAR, consistent with previously published results.

Previously, it was shown the pre-clinical efficacy of anti-CD123 chimeric antigen receptor for the treatment of acute myeloid leukemia. CART123 causes hematopoietic toxicity due to recognition of CD123 on hematopoietic stem and progenitor cells, a potentially major challenge to clinical translation as profound stem cell toxicity could lead to permanent myeloablation. It was hypothesized that to minimize hematopoietic toxicity, a novel construct that activated T cells only upon co-engagement of CD19 and CD123 simultaneously could obviate this hematopoietic toxicity. Here it was found that CART cells receiving an activating signal from CD19 recognition and a stimulatory signal from CD123 recognition could kill B-ALL cells as well as avoid the profound hematopoietic toxicity that we have previously described. Although this concept was previously published using an artificial system of CD19/PSMA recognition, this clinically relevant construct represents a major advance in the field with a relatively clear path to clinical translation. Notably, although such a dual CAR design will likely be associated with reduced toxicity, it may leave unaddressed the issue of antigen loss relapse by making CAR recognition more, rather than less restrictive. However, if targeting of CD123 successfully eradicates ALL stem cells, this approach could be both safe and efficacious.

In summary, demonstrated here is a novel and effective strategy to the treatment of B-ALL by targeting CD123. This approach is particularly attractive since CD123 is expressed in rare CD19-negative malignant cells in some patients with B-ALL and is retained in antigen-loss relapses occurring after CD19-directed immunotherapies. Moreover, the combination of CART19 with CART123 can prevent the occurrence of CD19-negative relapses.

Figure 59:
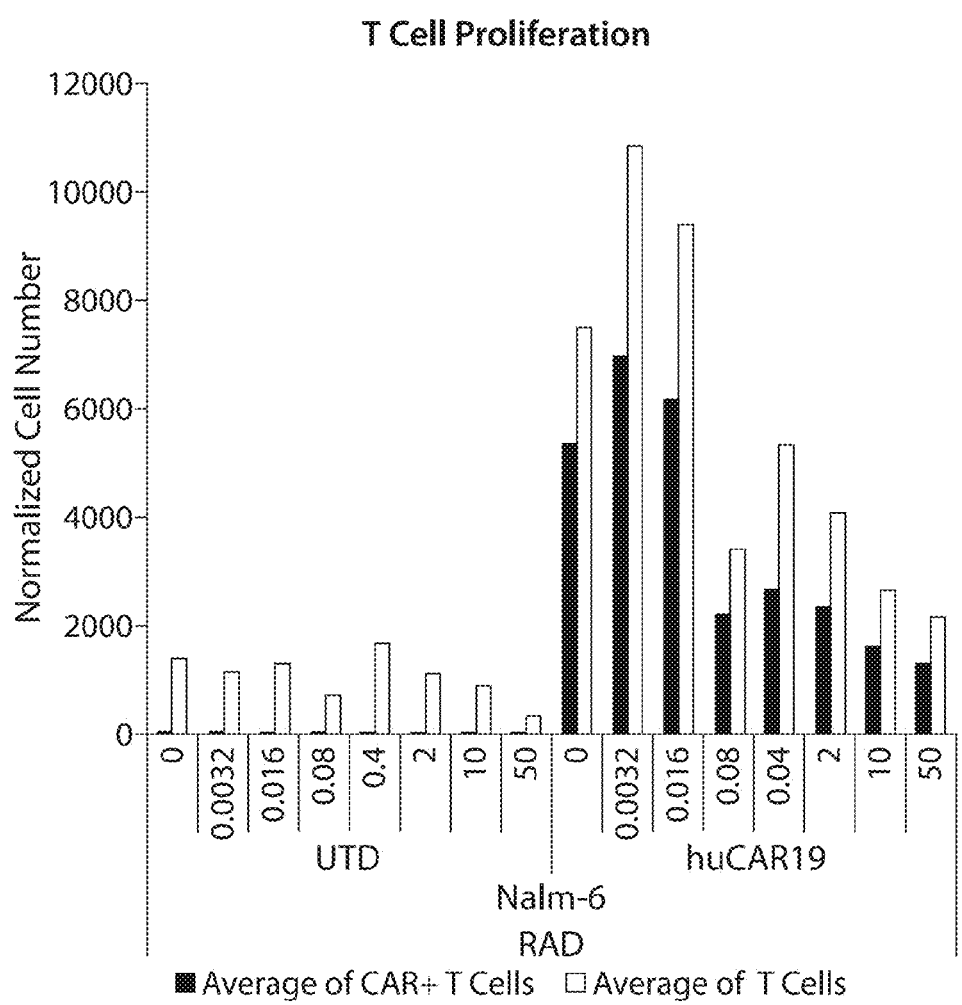
FIG. 59 shows that the proliferation of CAR-expressing, transduced T cells is enhanced by low doses of RAD001 in a cell culture system. CARTs were co-cultured with NALM6 (Nalm-6) cells in the presence of different concentrations of RAD001 (nM). The number of CAR-positive CD3-positive T cells (black) and total T cells (white) was assessed after 4 days of co-culture.

Example 18: Low Dose RAD001 Stimulates CART Proliferation in a Cell Culture Model The effect of low doses of RAD001 on CAR T cell proliferation in vitro was evaluated by co-culturing CART-expressing cells with target cells in the presence of different concentrations of RAD001.
  Materials and Methods
  Generation of CAR-Transduced T Cells
  A humanized, anti-human CD19 CAR (huCART19) lentiviral transfer vector was used to produce the genomic material packaged into VSVg pseudotyped lentiviral particles. The amino acid and nucleotide sequence of the humanized anti-human CD19 CAR (huCART19) is CAR 1, ID 104875, described in PCT publication, WO2014/153270, filed Mar. 15, 2014, and is designated SEQ ID NOs. 85 and 31 therein.
  Lentiviral transfer vector DNA is mixed with the three packaging components VSVg env, gag/pol and rev in combination with lipofectamine reagent to transfect Lenti-X 293T cells. Medium is changed after 24 h and 30 h thereafter, the virus-containing media is collected, filtered and stored at −80° C. CARTs are generated by transduction of fresh or frozen naïve T cells obtained by negative magnetic selection of healthy donor blood or leukopak. T cells are activated by incubation with anti-CD3/anti-CD28 beads for 24 h, after which viral supernatant or concentrated virus (MOI=2 or 10, respectively) is added to the cultures. The modified T cells are allowed to expand for about 10 days. The percentage of cells transduced (expressing the CARs on the cell surface) and the level of CAR expression (relative fluorescence intensity, Geo Mean) are determined by flow cytometric analysis between days 7 and 9. The combination of slowing growth rate and T cell size approaching ~350 fL determines the state for T cells to be cryopreserved for later analysis.
  Evaluating Proliferation of CARTs
  To evaluate the functionality of CARTs, the T cells are thawed and counted, and viability is assessed by Cellometer. The number of CAR-positive cells in each culture is normalized using non-transduced T cells (UTD). The impact of RAD001 on CARTs was tested in titrations with RAD001, starting at 50 nM. The target cell line used in all co-culture experiments is NALM6 (Nalm-6), a human pre-B cell acute lymphoblastic leukemia (ALL) cell line expressing CD19 and transduced to express luciferase.
  For measuring the proliferation of CARTs, T cells are cultured with target cells at a ratio of 1:1. The assay is run for 4 days, when cells are stained for CD3, CD4, CD8 and CAR expression. The number of T cells is assessed by flow cytometry using counting beads as reference.
  Results
  The proliferative capacity of CART cells was tested in a 4 day co-culture assay. The number of CAR-positive CD3-positive T cells (dark bars) and total CD3-positive T cells (light bars) was assessed after culturing the CAR-transduced and non-transduced T cells with NALM6 (Nalm-6) (FIG. 59). huCART19 cells expanded when cultured in the presence of less than 0.016 nM of RAD001, and to a lesser extent at higher concentrations of the compound. Importantly, both at 0.0032 and 0.016 nM RAD001 the proliferation was higher than observed without the addition of RAD001. The non-transduced T cells (UTD) did not show detectable expansion.

Example 19: Low Dose RAD001 Stimulates CART Expansion In Vivo

This example evaluates the ability of huCAR19 cells to proliferate in vivo with different concentrations of RAD001.
  Materials and Methods:
  NALM6-luc cells: The NALM6 human acute lymphoblastic leukemia (ALL) cell line was developed from the peripheral blood of a patient with relapsed ALL. The cells were then tagged with firefly luciferase. These suspension cells grow in RPMI supplemented with 10% heat inactivated fetal bovine serum.
  Mice: 6 week old NSG (NOD.Cg-PrkdcscidIl2rgtm1Wjl/SzJ) mice were received from the Jackson Laboratory (stock number 005557).
  Tumor implantation: NALM6-luc cells were grown and expanded in vitro in RPMI supplemented with 10% heat inactivated fetal bovine serum. The cells were then transferred to a 15 ml conical tube and washed twice with cold sterile PBS. NALM6-luc cells were then counted and resuspended at a concentration of $10 \times 10^6$ cells per milliliter of PBS. The cells were placed on ice and immediately (within one hour) implanted in the mice. NALM6-luc cells were injected intravenously via the tail vein in a 100 μl volume, for a total of 1×10$^6$ cells per mouse.

CAR T cell dosing: Mice were administered 5×10$^6$ CAR T cells 7 days after tumor implantation. Cells were partially thawed in a 37 degree Celsius water bath and then completely thawed by the addition of 1 ml of cold sterile PBS to the tube containing the cells. The thawed cells were transferred to a 15 ml falcon tube and adjusted to a final volume of 10 mls with PBS. The cells were washed twice at 1000 rpm for 10 minutes each time and then counted on a hemocytometer. T cells were then resuspended at a concentration of 50×10$^6$ CAR T cells per ml of cold PBS and kept on ice until the mice were dosed. The mice were injected intravenously via the tail vein with 100 μl of the CAR T cells for a dose of 5×10$^6$ CAR T cells per mouse. Eight mice per group were treated either with 100 μl of PBS alone (PBS), or humanized CD19 CAR T cells.

RAD001 dosing: A concentrated micro-emulsion of 50 mg equal to 1 mg RAD001 was formulated and then resuspended in D5W (dextrose 5% in water) at the time of dosing. Mice were orally dosed daily (via oral gavage) with 200 μl of the desired doses of RAD001.

PK analysis: Mice were dosed daily with RAD001 starting 7 days post tumor implantation. Dosing groups were as follows: 0.3 mg/kg, 1 mg/kg, 3 mg/kg, and 10 mg/kg. Mice were bled on days 0 and 14 following the first and last dose of RAD001, at the following time points for PK analysis: 15 minutes, 30 minutes, 1 hour, 2 hours, 4 hours, 8 hours, 12 hours, and 24 hours.

Figure 60:
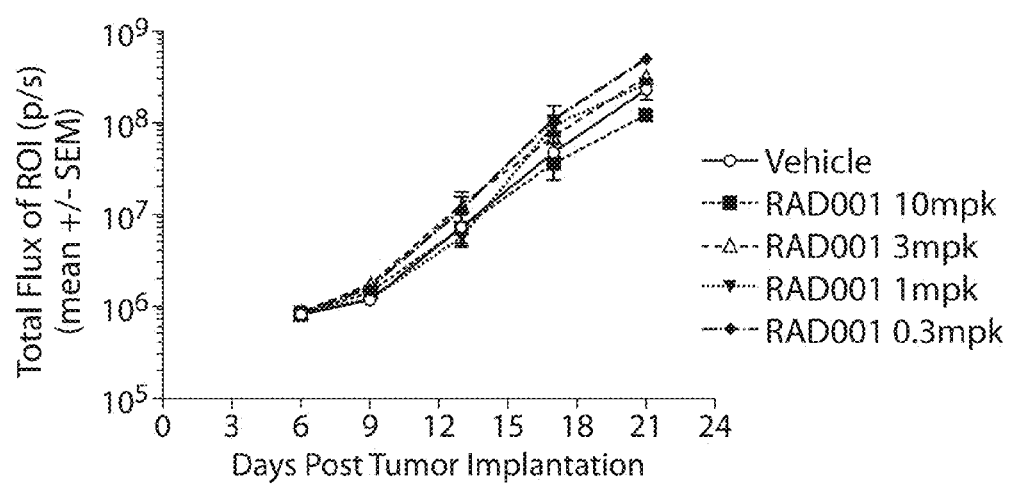
FIG. 60 depicts tumor growth measurements of NALM6-luc cells with daily RAD001 dosing at 0.3, 1, 3, and 10 mg/kg (mpk) or vehicle dosing. Circles denote the vehicle; squares denote the 10 mg/kg dose of RAD001; triangles denote the 3 mg/kg dose of RAD001, inverted triangles denote the 1 mg/kg dose of RAD001; and diamonds denote the 0.3 mg/kg dose of RAD001.
Figure 61A:
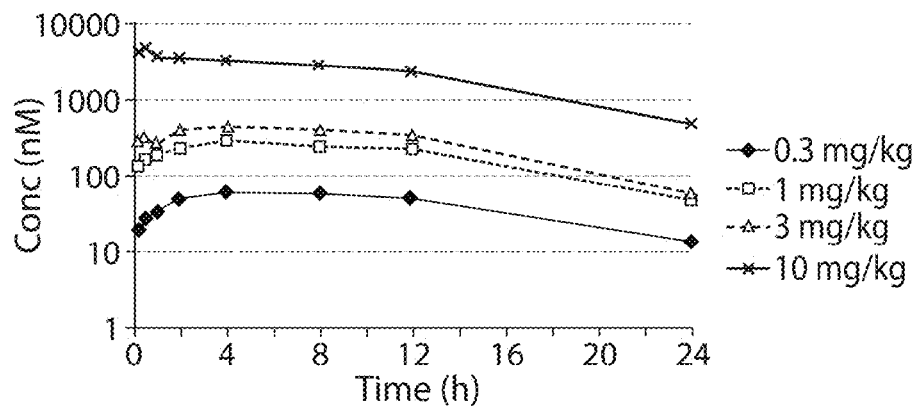
FIGS. 61A and 61B show pharmacokinetic curves showing the amount of RAD001 in the blood of NSG mice with NALM6 tumors.
Figure 61B:
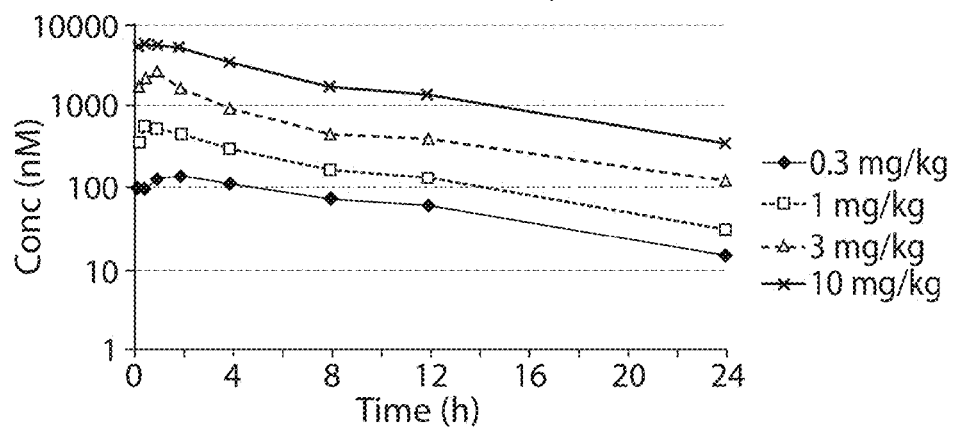

Results:

The expansion and pharmacokinetics of RAD001 was tested in NSG mice with NALM6-luc tumors. Daily oral dosing of RAD001 alone did not have an impact on the growth of NALM6-luc tumors (FIG. 60). The pharmacokinetic analysis of RAD001 shows that it is fairly stable in the blood of tumor bearing mice (FIGS. 61A and 61B). Both the day 0 and day 14 PK analyses show that the RAD001 concentrations in the blood is above 10 nm even 24 hours after dosing at the lowest dose tested (0.3 mg/kg).

Based on these doses, huCAR19 CAR T cells were dosed with and without RAD001 to determine the proliferative ability of these cells. The highest dose used was 3 mg/kg based on the levels of RAD001 in the blood 24 hours after dosing. As the concentration of RAD001 was above 10 nM 24 hours after the final dose of RAD001, several lower doses of RAD001 were used in the in vivo study with CAR T cells. The CAR T cells were dosed IV one day prior to the start of the daily oral RAD001 dosing. Mice were monitored via FACS for T cell expansion.

Figure 62A:
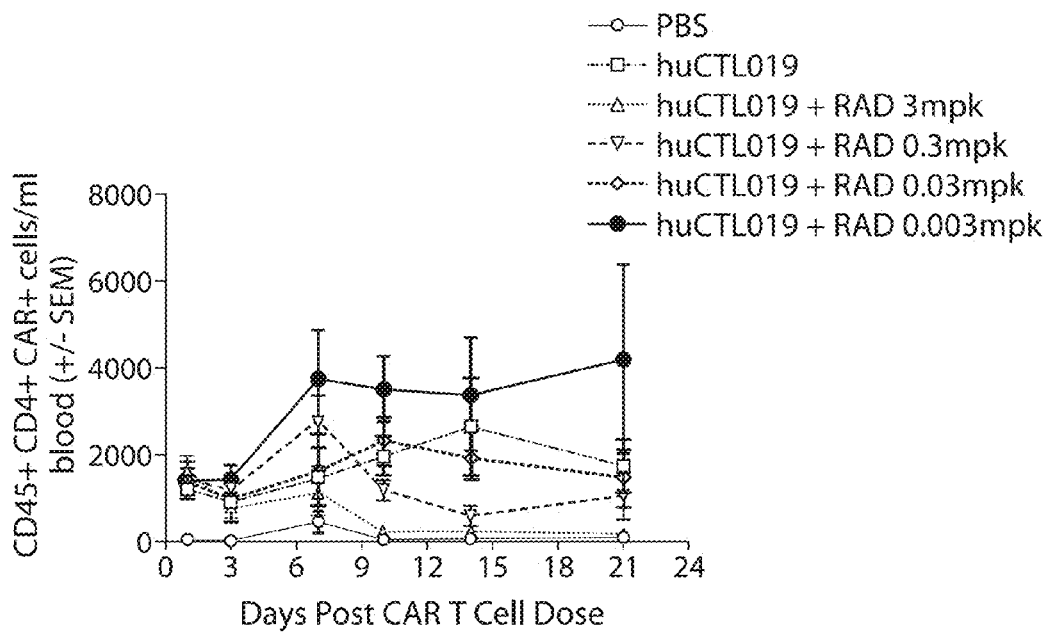
FIGS. 62A and 62B show in vivo proliferation of humanized CD19 CART cells with and without RAD001 dosing. Low doses of RAD001 (0.003 mg/kg) daily lead to an enhancement in CAR T cell proliferation, above the normal level of huCAR19 proliferation.
Figure 62B:
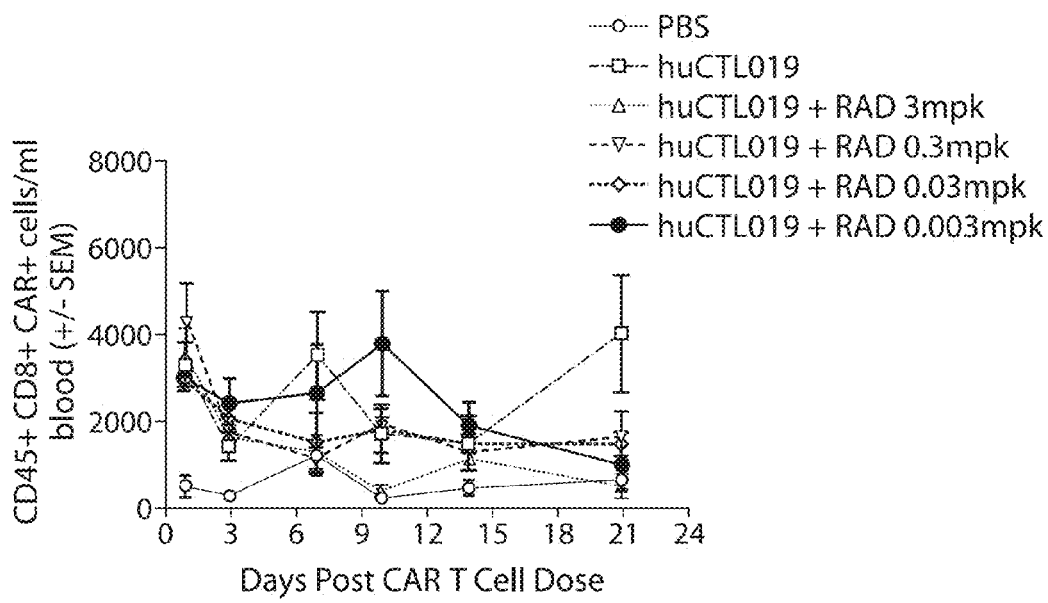

The lowest doses of RAD001 show an enhanced proliferation of the CAR T cells (FIGS. 62A and 62B). This enhanced proliferation is more evident and prolonged with the CD4+ CAR T cells than the CD8+ CAR T cells. However, with the CD8+ CAR T cells, enhanced proliferation can be seen at early time points following the CAR T cell dose.

Example 20: Certain Patients with Primary DLBCL Show CD3+/PD1+ Dual Positive Cancer Cells Although there have been compelling advances in the cancer immunotherapy space recently in the form of chimeric antigen receptor (CAR) modified T-cells and checkpoint inhibitors, advanced tools to explore the therapeutic mechanisms of their combination are not widely available. To address this growing need, a robust quantitative fluorescent immunohistochemistry platform using multiplex AQUA (Automated Quantitative Analysis) technology was developed to evaluate checkpoint inhibitor expression, enumerate CAR T cells and determine the interaction between tumor cells and immune cells via novel co-localization algorithms. The utility of this method was characterized both in pre-clinical- and clinical model systems. In an immunodeficient mouse model of B-cell lymphoma, homing of CAR T cells to malignant B-cells in primary lymphoid organs was evaluated. The phenotype and functional status of the CAR T cells via multiplex analyses of CD4, CD8, PD1 and FOXP3 expression was determined. Additionally, to enable combination immunotherapies in Diffuse Large B-Cell Lymphoma (DLBCL) setting, prevalence of adaptive immune resistance mechanisms in the form of PD1 and PD-L1 expression in immune- and tumor cell compartments was examined via landmarks created by cytoplasmic and nuclear stains in both primary and secondary biopsies from DLBCL patients (n=63). To support patient selection for CAR T trials, expression and prevalence of relevant tumor antigens that could not be scored reproducibly by traditional methods were quantified to yield objective cut points. These quantitative multiplexed MC methods for optimal selection of patients can be utilized in upcoming novel combination immunotherapy trials.

Sample preparation, imaging, and analysis of imaging for DLBCL tissue samples was performed on primary DLBCL (n=49) and secondary DLBCL (15) human patients.

Sample Preparation.

Formalin fixed paraffin embedded (FFPE) tissue samples were dewaxed. The slides were then rehydrated through a series of xylene to alcohol washes before incubating in distilled water. Heat-induced antigen retrieval was then performed using elevated pressure and temperature conditions, allowed to cool, and transferred to Tris-buffered saline. Staining was then performed where the following steps were carried out. First, endogenous peroxidase was blocked followed by incubation with a protein-blocking solution to reduce nonspecific antibody staining. Next, the slides were stained with a mouse anti-PD1 primary antibody. Slides were then washed before incubation with an anti-mouse HRP secondary antibody. Slides were washed and then PD-1 staining was detected using TSA+Cy® 5 (Perkin Elmer). Primary and secondary antibody reagents were then removed via microwave. The slides were again washed before staining with a rabbit anti-CD3 primary antibody. Slides were washed and then incubated with a cocktail of anti-rabbit HRP secondary antibody plus 4',6-diamidino-2-phenylindole (DAPI). Slides were washed and then CD3 staining was detected using TSA-Cy® 3 (Perkin Elmer). Slides were washed a final time before they were cover-slipped with mounting media and allowed to dry overnight at room temperature.

Sample Imaging and Analysis.

Fluorescence images were then acquired using the Vectra 2 Intelligent Slide Analysis System using the Vectra software version 2.0.8 (Perkin Elmer). First, monochrome imaging of the slide at 4× magnification using DAPI was conducted. An automated algorithm (developed using inForm) was used to identify areas of the slide containing tissue.

The areas of the slide identified as containing tissue were imaged at 4× magnification for channels associated with DAPI (blue), Cy®3 (green), and Cy® 5 (red) to create RGB images. These 4× magnification images were processed using an automated enrichment algorithm (developed using inForm) in field of view selector to identify and rank possible 20× magnification fields of view according to the highest Cy® 3 expression.

The top 40 fields of view were imaged at 20× magnification across DAPI, Cy®3, and Cy® 5 wavelengths. Raw images were reviewed for acceptability, and images that were out of focus, lacked any tumor cells, were highly necrotic, or contained high levels of fluorescence signal not associated with expected antibody localization (i.e., background staining) were rejected prior to analysis. Accepted images were processed using AQUAduct (Perkin Elmer), wherein each fluorophore was spectrally unmixed by spectral unmixer into individual channels and saved as a separate file.

Figure 63:
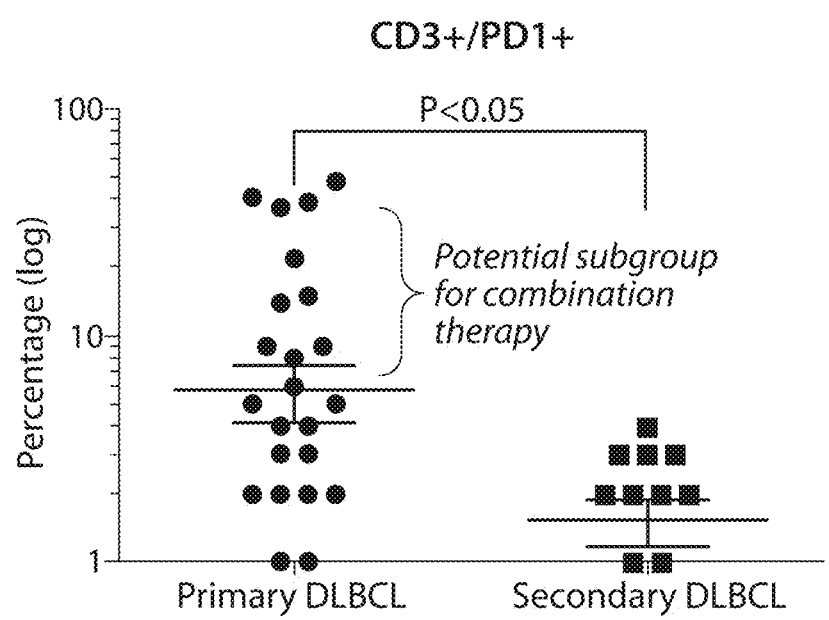
FIG. 63 shows multiplex FIHC AQUA analysis showing significant difference between CD3+/PD-1+ cell populations in primary and secondary human DLBCL patient samples.

The processed files were further analyzed using AQUAnalysis™ or through a fully automated process using AQUAserve™. Each DAPI image was processed by cell masker to identify all cell nuclei within that image, and then dilated by 2 pixels to represent the approximate size of an entire cell. This resulting mask represented all cells within that image. Each Cy® 5 image was processed by biomarker masker to create a binary mask of all cells that are PD-1-positive. Each Cy® 3 image was processed by biomarker masker to create a binary mask of all cells that are CD3-positive. The binary masks for all cells PD-1-positive and CD3-positive were combined to create a binary mask of all cells that are double positive for PD-1 and CD3. The % biomarker positivity (PBP) for all CD3 cells expressing PD-1 was derived, using positivity calculator, by dividing the total area, measured in pixels and determined by area evaluator, of the mask of all PD-1-positive tumor cells with the total area, measured in pixels and determined by area evaluator, of the mask of all CD3-positive cells. Representative values of PBP for all CD3-positive cells expressing PD-1 in primary and secondary DLBCL human samples are shown in FIG. 63. CD3 and PD-1 status showed that prevalence rates of CD3+/PD-1+ cells in primary is higher than secondary DLBCL setting, providing an opportunity to select patient for either single or combination treatment.

A similar experiment was performed in which PD-L1 was detected using a rabbit anti-PDL1 primary antibody and TSA+Cy5 (Perkin Elmer) on DLBCL tissue samples from primary DLBCL human patients. PD1 and CD3 were also detected on the same samples. The experiment showed that tumor microenvironments comprise cells that express PD1, CD3, and PDL1. The experiment also identified a sub-population of cells that is CD3+PD1+ (data not shown). These results support the model that a tumor microenvironment fosters immune suppressive cells that can be targeted with agents specific to PD1+ or PD-L1+ cells.

Example 21: Mutually Exclusive Expression of CD19 and PD-L1 in Samples Comprising DLBCL Cells Sample Preparation.

Formalin fixed paraffin embedded (FFPE) tissue samples were dewaxed. The slides were then rehydrated through a series of xylene to alcohol washes before incubating in distilled water. Heat-induced antigen retrieval was then performed using elevated pressure and temperature conditions, allowed to cool, and transferred to Tris-buffered saline. Staining was then performed where the following steps were carried out. First, endogenous peroxidase was blocked followed by incubation with a protein-blocking solution to reduce nonspecific antibody staining. Next, the slides were stained with a rabbit anti-PDL1 primary antibody. Slides were then washed before incubation with an anti-rabbit HRP secondary antibody. Slides were washed and then PDL1 staining was detected using TSA+Cy® 3 (Perkin Elmer). Primary and secondary antibody reagents were then removed via microwave. The slides were again washed before staining with a mouse anti-CD19 primary antibody. Slides were washed and then incubated with a cocktail of anti-mouse HRP secondary antibody plus 4',6-diamidino-2-phenylindole (DAPI). Slides were washed and then CD19 staining was detected using TSA-Cy® 5 (Perkin Elmer). Slides were washed a final time before they were cover-slipped with mounting media and allowed to dry overnight at room temperature.

Sample Imaging and Analysis.

Fluorescence images were then acquired using the Vectra 2 Intelligent Slide Analysis System using the Vectra software version 2.0.8 (Perkin Elmer). First, monochrome imaging of the slide at 4× magnification using DAPI was conducted. An automated algorithm (developed using inForm) was used to identify areas of the slide containing tissue.

The areas of the slide identified as containing tissue were imaged at 4× magnification for channels associated with DAPI (blue), Cy®3 (green), and Cy® 5 (red) to create RGB images. These 4× magnification images were processed using an automated enrichment algorithm (developed using inForm) in field of view selector to identify and rank possible 20× magnification fields of view according to the highest Cy® 3 expression.

The top 40 fields of view were imaged at 20× magnification across DAPI, Cy®3, and Cy® 5 wavelengths. Raw images were reviewed for acceptability, and images that were out of focus, lacked any tumor cells, were highly necrotic, or contained high levels of fluorescence signal not associated with expected antibody localization (i.e., background staining) were rejected prior to analysis. Accepted images were processed using AQUAduct (Perkin Elmer), wherein each fluorophore was spectrally unmixed by spectral unmixer into individual channels and saved as a separate file.

The processed files were further analyzed using AQUAnalysis™ or through a fully automated process using AQUAserve™ as described in the previous Example.

Figure 64:
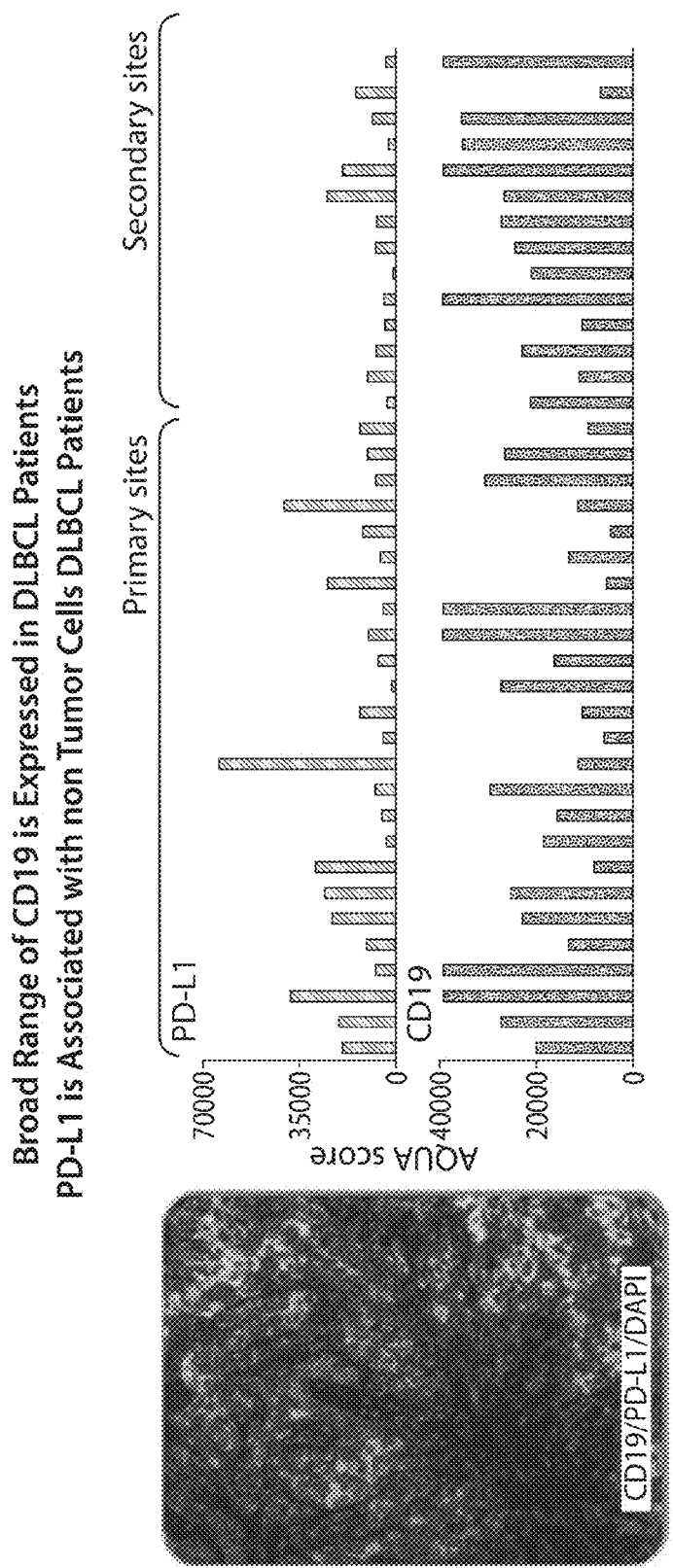
FIG. 64 shows AQUA analysis showing various levels of CD19 (lower panel) and PD-L1 (upper panel) in primary and secondary sites of DLBCL samples. A total of 40 human DLBCL patient samples, 25 primary and 15 secondary sites, were subjected to multiplex FIHC and followed by AQUA analysis to identify expression levels of CD19 and PD-L1 proteins.

Representative values of PBP for all CD19-positive and PD-L1-positive cells in primary and secondary DLBCL human samples are shown in FIG. 64. CD19 and PDL1 expression varied in DLBCL samples. CD19 and PDL1 expression tended to be mutually exclusive, i.e., in general, a given cell expressed CD19 or PD-L1 but not both. While not wishing to be bound by theory, this may be because CD19 is expressed in DLBCL tumor cells while PD-L1 is expressed in non-tumor cells, e.g., cells that support the tumor microenvironment. This observation suggests that a combination therapy of a CD19 inhibitor (e.g., a CD19 CAR-expressing cell) and an inhibitor of PD-L1 signalling may be useful for targeting these two populations of cells.

A similar experiment was performed to, e.g., demonstrate the capability of AQUA analysis to monitor CART19 efficacy. This study monitored CD19, CD3, and the CART19 nucleic acid in samples comprising mixed cells lines with CART19+ Jurkat cells and CD19+ REH cells. CD19 and CD3 proteins were detected by antibodies, and CART19 was detected using an RNA probe against the 3' UTR of the CAR nucleic acid. The experiment showed that the cell line samples comprise cells that express CD19, CD3, and the CART19 (data not shown). The experiment also showed that the cell line samples comprise a sub-population of cells that is CD3+/CART19+ (data not shown). Proximity analysis was performed, which showed that CART19 cells were physically proximal to CD19+ cells (data not shown). These experiments support the model that CD3+ CART19 cells infiltrate a tumor microenvironment comprising CD19+ cells and physical locations of CD19 and CART19 cells translate into efficacy of the CART19 therapy.

Example 22: Bicistronic Expression of CARs

Figure 65:
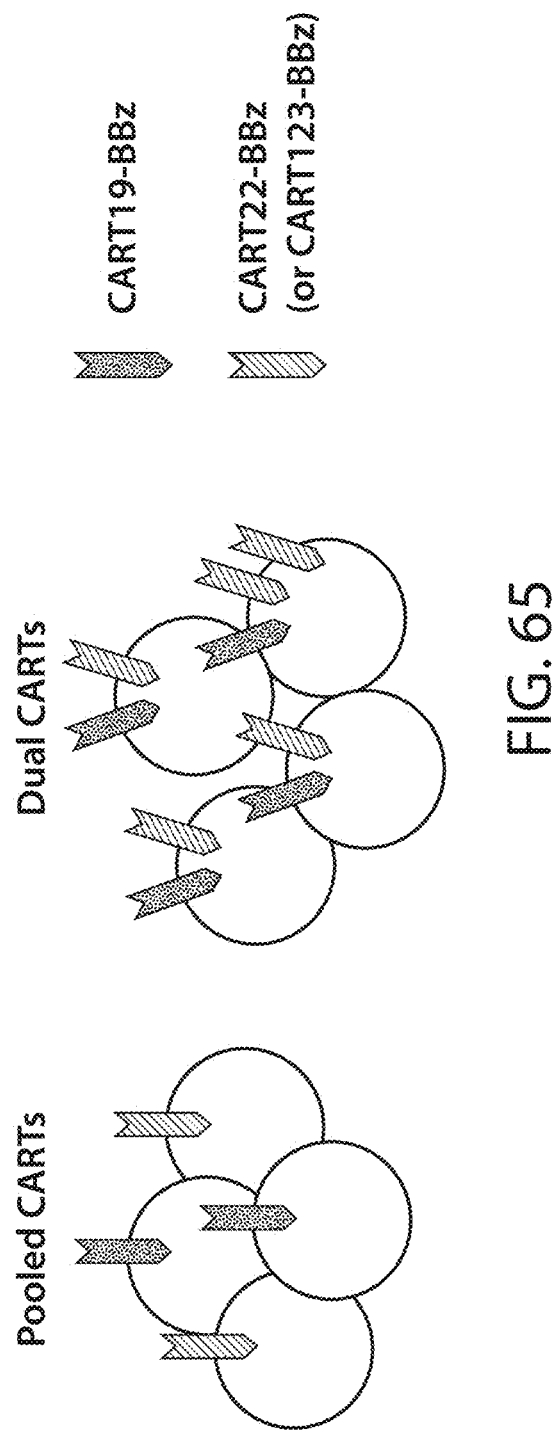
FIG. 65 shows a schematic of two populations of CAR-expressing cells. In the population on the left (pooled), each cell expresses one type of CAR. In the population on the right (bicistronic CAR), each cell expresses two types of CAR.

In this Example, the efficacy of two types of cell populations were compared. In the first cell population, referred to as "pooled", each cell expresses one CAR. A first plurality of cells was transduced with CD19 CAR, a second plurality of cells was transduced with CD22 CAR or CD123 CAR, and then the two pluralities of cells were pooled. In the second type of cell population, a plurality of cells was transduced with a bicistronic vector expressing CD19 CAR and a second CAR, so that most or all of the cells expressed both constructs. The second CAR was CD22 CAR in some experiments and CD123 CAR in others. These cell populations are illustrated in FIG. 65.

Figure 66:
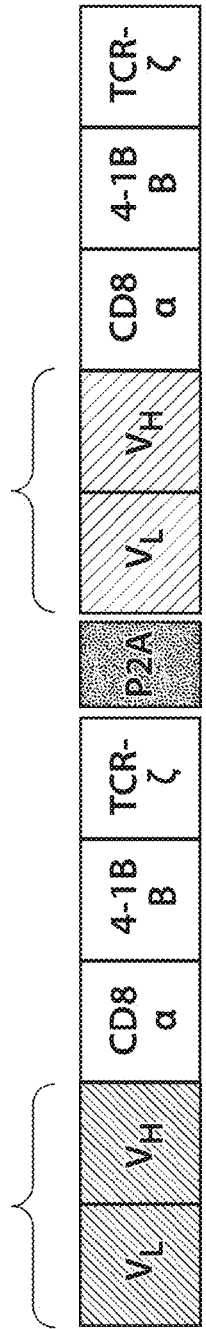
FIG. 66 shows diagrams of bicistronic CARs. The upper CAR has a CD19 CAR and a CD22 CAR, separated by a P2A protease cleavage site. The lower CAR has a CD19 CAR and a CD123 CAR, separated by a P2A protease cleavage site.
Figure 66:
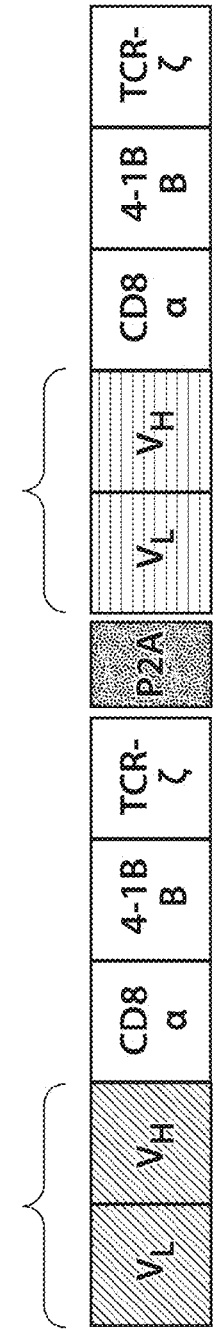
Figure 67:
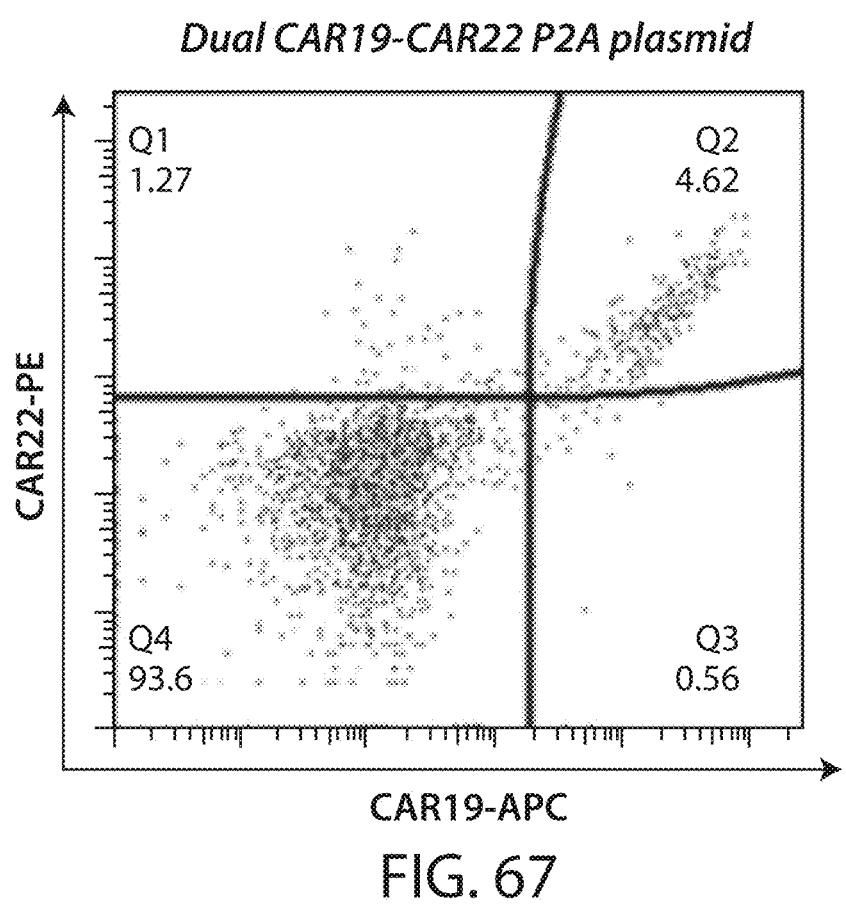
FIG. 67 shows co-expression of CD19 and CD22 CARs from a bicistronic vector.
Figure 68A:
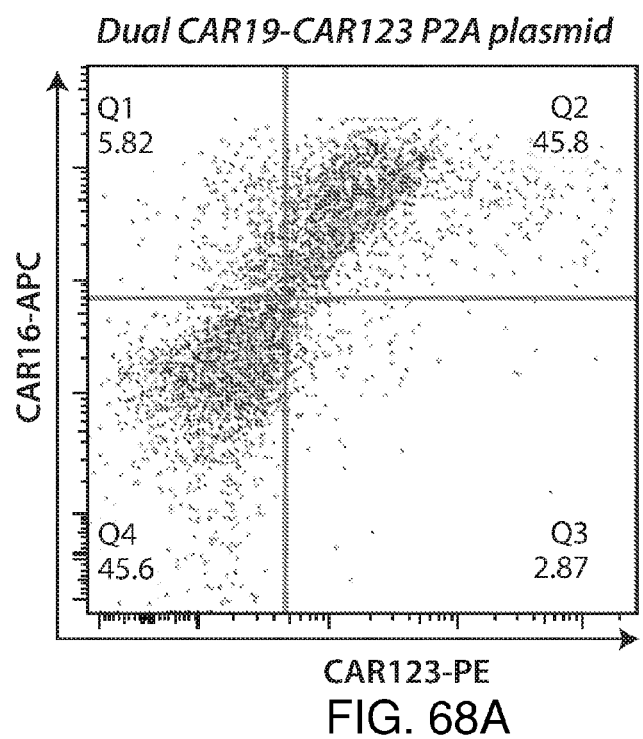
FIG. 68A shows co-expression of CD19 and CD123 CARs from a bicistronic vector.

Two novel constructs, diagrammed in FIG. 66, were generated using the P2A system in order to express two full-length CARs in the same T cell using a single bicistronic lentiviral vector. T cells were expanded according to a standard protocol and transduced using a single lentiviruse carrying both CAR19 and CAR123 (multiplicity of infection, MOI=3). A similar transduction was performed for CAR19 and CAR22 in the same T cell population obtained using the described bicistronic lentiviral vector. FIG. 67 shows co-expression of CD19 and CD22 CARs. Distinct populations based on the specific expression of CAR19 and/or CAR123 can be recognized, including a Dual CAR19+/CAR123+ population and a double negative population (FIG. 68A).

Figure 68B:
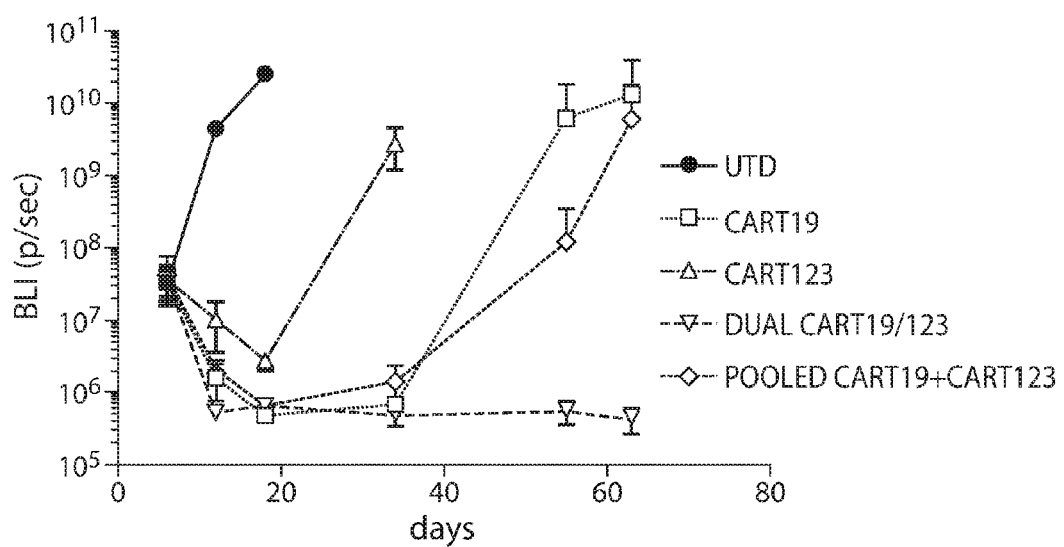
FIG. 68B shows the anti-leukemic effect of these cells.

The cells transduced with bicistronic CD19 CAR and CD123 CAR was compared with pooled cells expressing either CD19 or CD123 CAR (FIG. 68B). NSG mice were engrafted with a B-ALL cell line (NALM-6, CBG+). At day 7 mice were randomized based on tumor burden (BLI, bioluminescence) to receive control T cells (UTD), CART19, CART123, the 1:1 pooled combination of CART123 and CART19 or the Dual CART19/123 (same total number of CAR+ cells). CD19 CAR-expressing cells alone (squares) and CD123 CAR-expressing cells alone (triangles) both showed initial effectiveness compared to the control (circles) followed by rising levels of leukemic cells. Pooled cells expressing CD19 or CD123 (diamond) also showed initial effectiveness followed by rising levels of leukemic cells. In contrast, cells transfected with the bicistronic vector (inverted triangles, "dual CART") maintained a prolonged response at least 60 days after treatment. This experiment indicates that dual CARTs exert a potent anti-leukemia effect that is not only superior to a single CART treatment but is superior to a pooled CART cells.

Example 23: CART22 is Effective Against CD19-Neg B-ALL in an Animal Model

Figure 69:
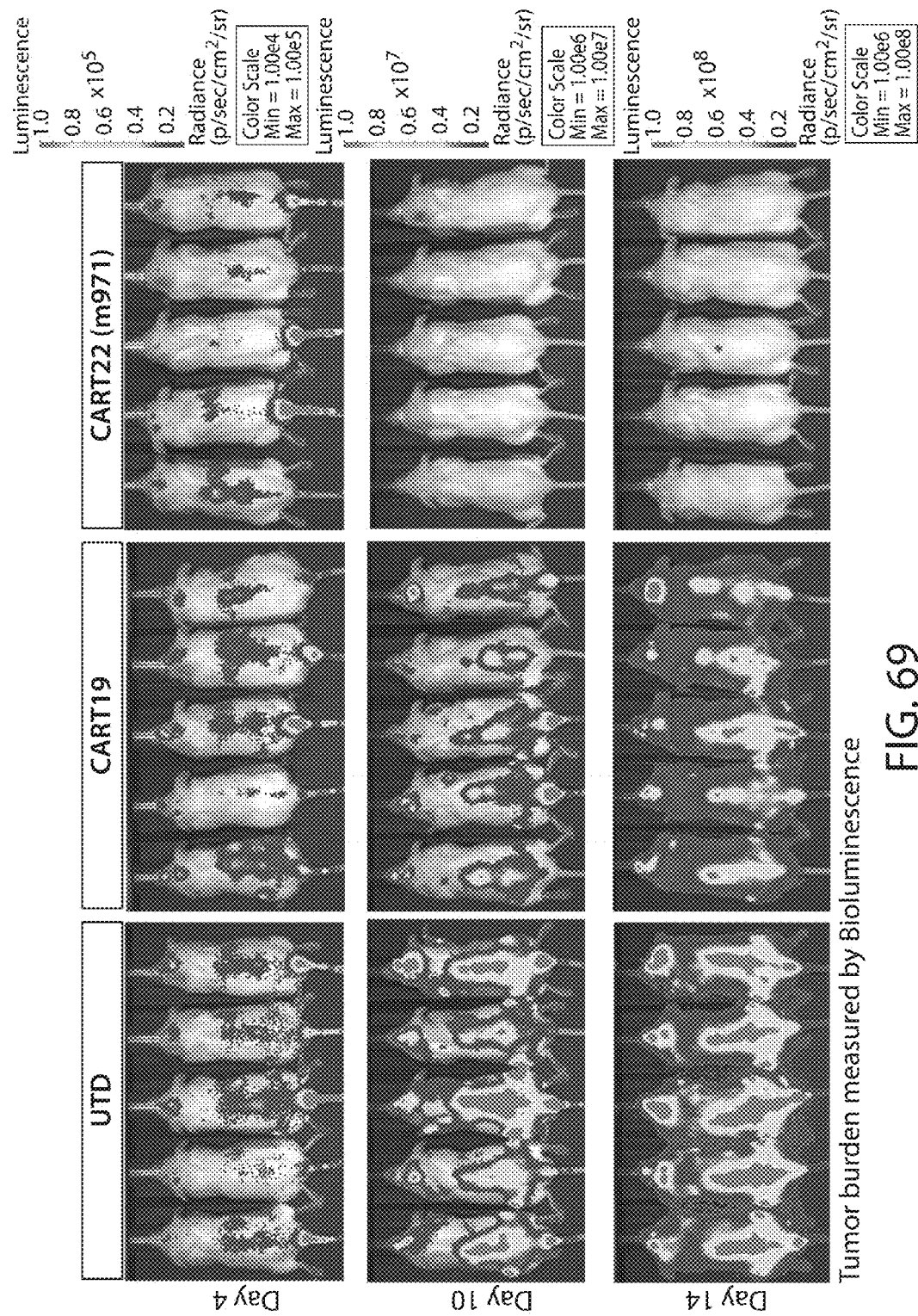
FIG. 69 shows the tumor burden in mice bearing CD19-negative B-ALL xenografts after treatment with a UTD control, CART19, or CART22.

CD19-negative B-ALL cells were tested for responsiveness to CD19 CAR-expressing cells and CD22 CAR-expressing cells in an animal model. One million CD19-negative B-ALL cells were infused into mice on day 0, and 2e6 CAR+ T cells were infused on day 7 (after randomization). Tumor burden was measured by bioluminescence. As shown in FIG. 69, while the cancer progressed in the negative control mice and CART19-treated mice, CART22 is able to clear CD19-negative ALL in NSG xenografts.

The assay was conducted as follows: 1e6 CD19-neg ALL cells (CBG+) were injected in NSG mice. At day 5 mice were randomized to receive either 2e6 control untransduced T cells (UTD), CART19 or CART22 (m971 scFv). Mice were then followed uo for tumor burden (bioluminescence).

Example 24: Low Levels of Immune Checkpoint Molecules are Associated with Improved Outcomes Immune checkpoint molecules (PD-L1, PD1, LAG3, and TIM3) were detected in samples from lymphoma patients by immunohistochemistry. Positive and negative control tissues and cell lines were also performed. The immune checkpoint expression analysis was performed using quantitative image analysis on a region of interest which can include tumor cells and non-tumor cells such as immune cells. Samples were taken from tissue, lymph node, or bone marrow.

Figure 70:
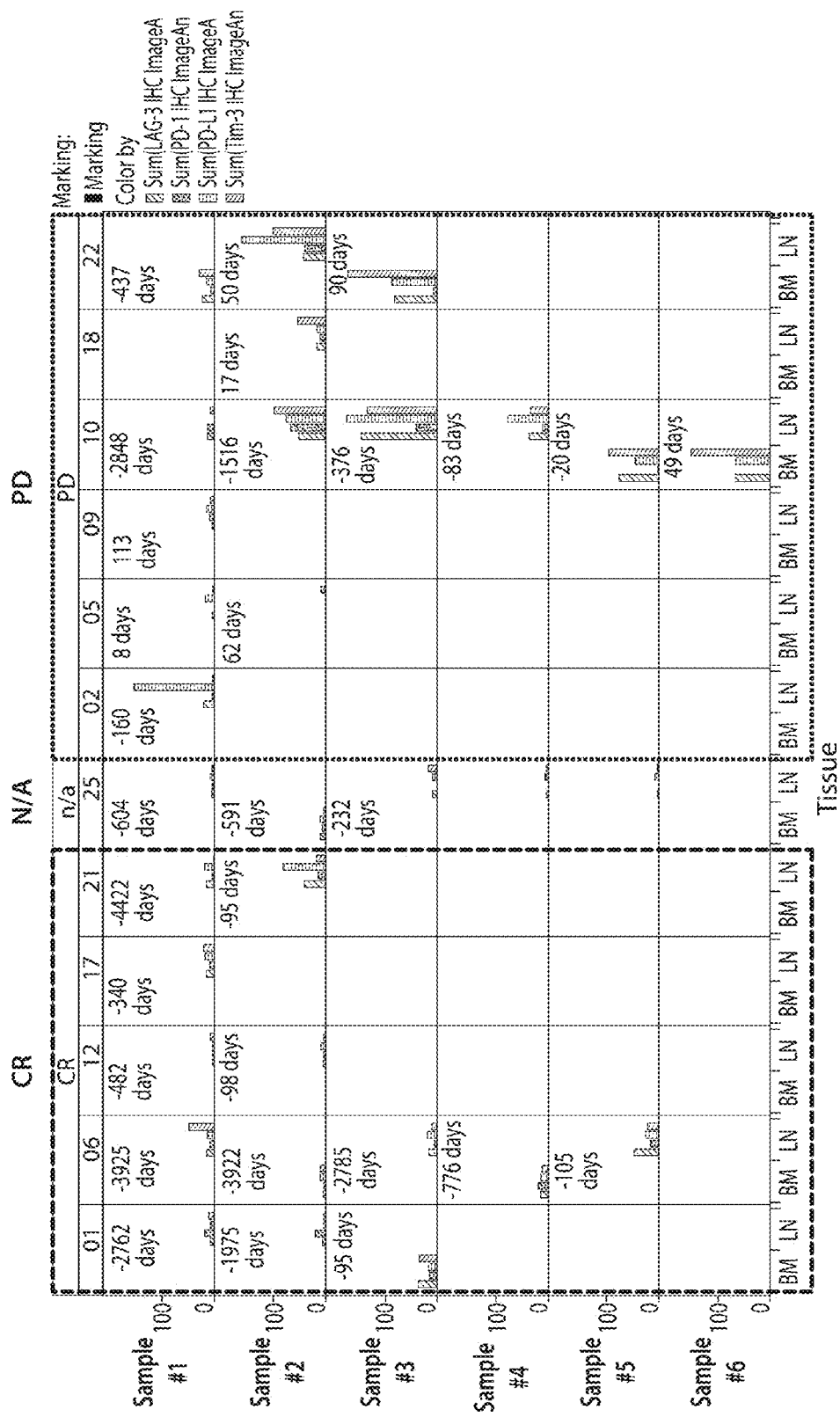
FIG. 70 shows the expression of PD-L1, PD1, LAG3, and TIM3 (from left to right in each set of four bars) in lymph node and bone marrow samples from five CR patients, one unclassified patient, and six PD patients.

Immune checkpoint protein expression was compared in complete responders (CR) and patients having progressive disease (PD) following treatment with CD19-targeting CAR therapy. As shown in FIG. 70, the CR patients tended to have low levels of PD-L1, PD1, LAG3, and TIM3 before and after treatment, while PD patients tended to have high levels of these molecules before and after treatment. This Example supports combination therapy with a CAR-expressing cell and an immune checkpoint inhibitor, and supports testing to determine immune checkpoint molecule levels in patients receiving a CAR therapy.

Example 25: Functional Assays of CD22 CAR-Expressing Cells

Several CD22 CAR constructs were functionally validated in an NFAT assay. Briefly the experiments were performed as follows. A lentiviral vector (pELPS) carrying a nucleic acid, encoding a CD22 CAR with a CD22-binding scFv domain was introduced by electroporation into a Jurkat T cell line modified to express luciferase under the control of an NFAT response element (JNL). The cells were cultured and allowed to express the CAR construct. The electroporated cells were applied to a plate coated with the target antigen (CD22). Detection of luciferase signal in the coated plate was indicative of binding activity of the CD22 CAR to its antigen, leading to activation of the T cells and expression of luciferase.

Figure 71:
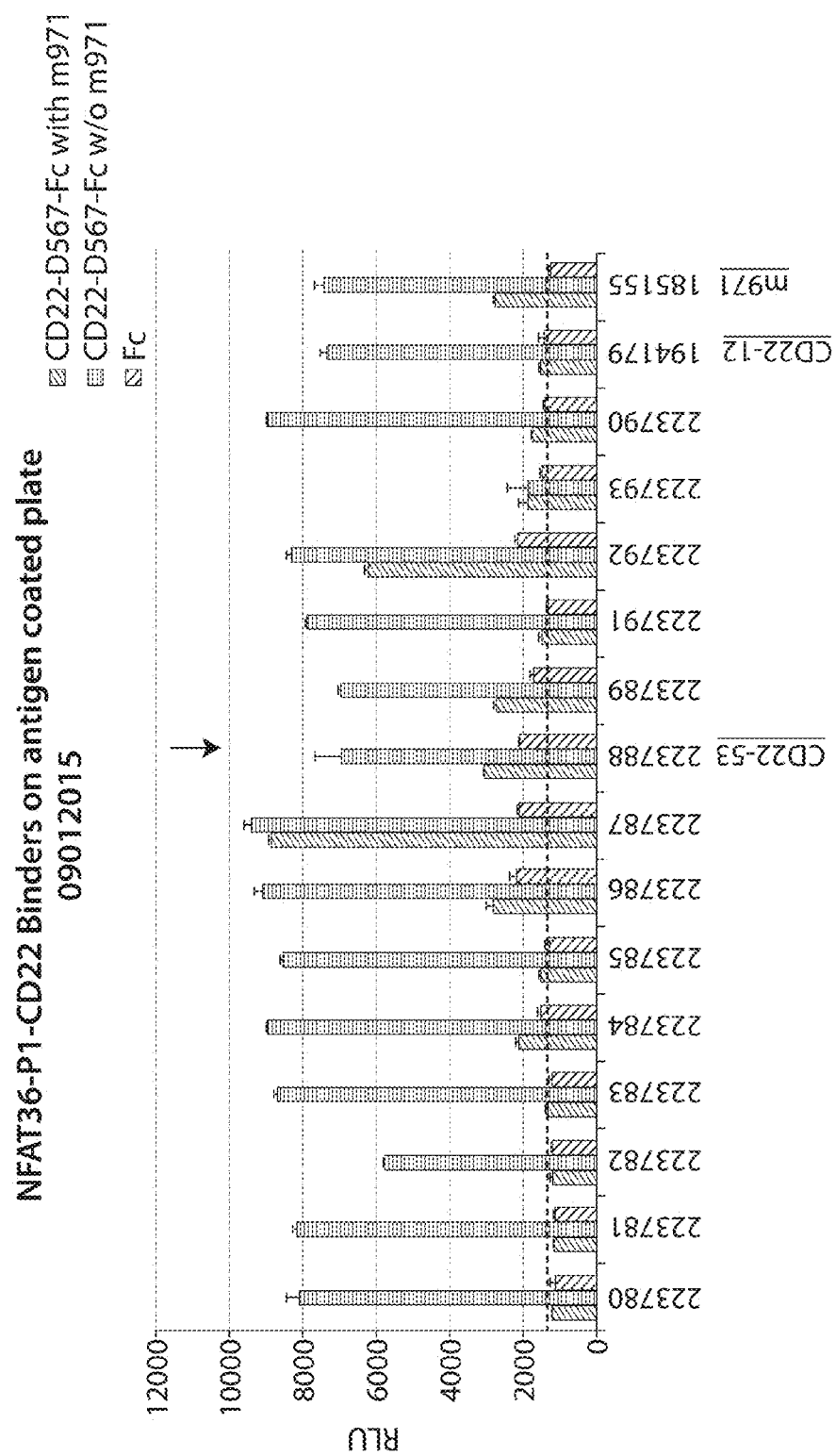
FIG. 71 is a graph showing the activation (in RLU) of several CD22 CAR constructs in the presence and absence of a m971 competitor.

FIG. 71 is a graph showing the activation (in RLU) of several CD22 CAR constructs in the presence and absence of a m971 scFv competitor. These results indicate that CD22-53 and CD22-12, and a subset of the other scFvs, bind the antigen approximately as well as the m971 positive control. The results also indicate that the different scFvs compete with m971 to different extents.

Sixteen additional human CD22 binding domains were tested and found to have weak binding activity (data not shown), so were not pursued further.

Figure 72:
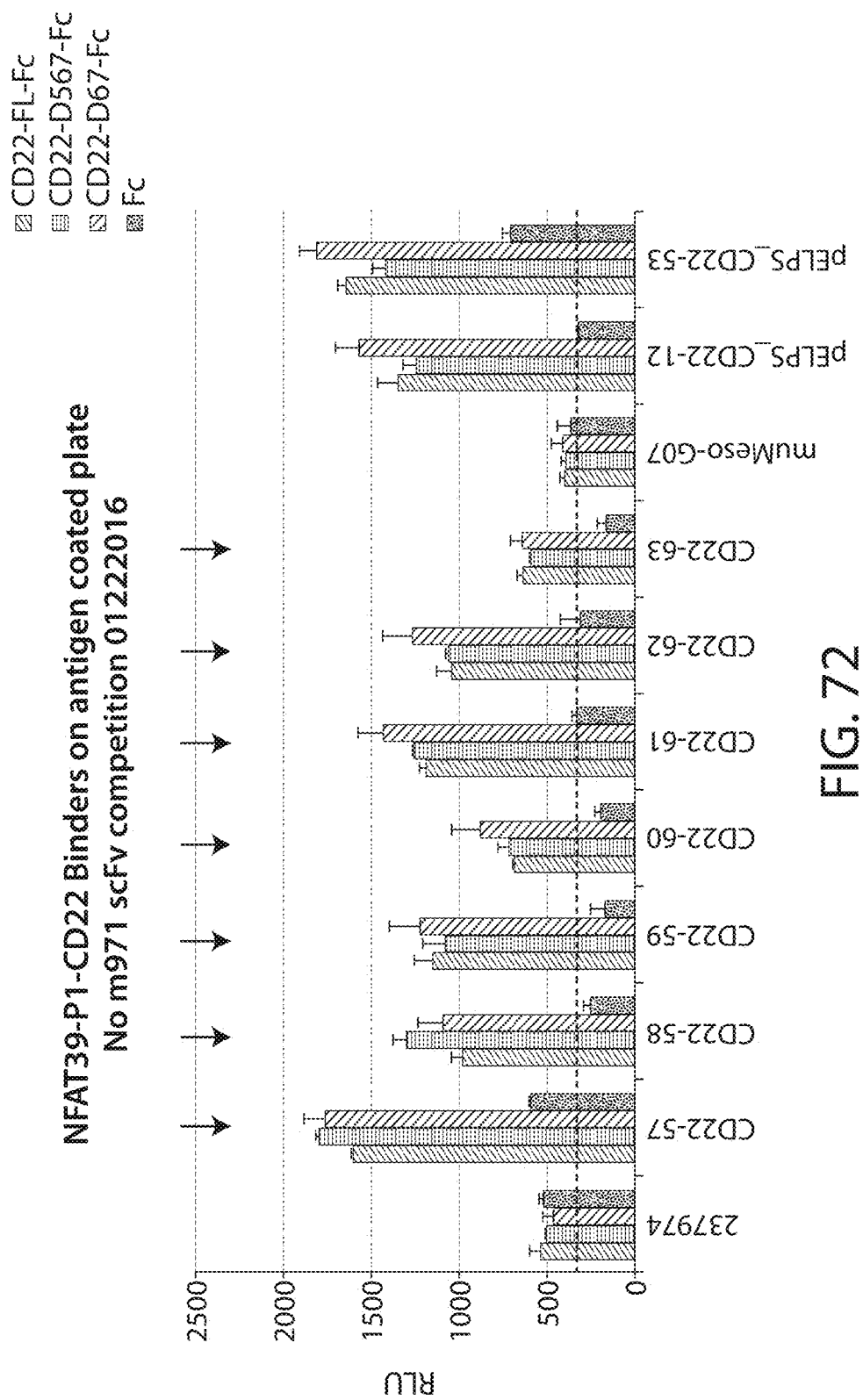
FIG. 72 is a graph showing the activation (in RLU) of additional CD22 CAR constructs.
Figure 75:
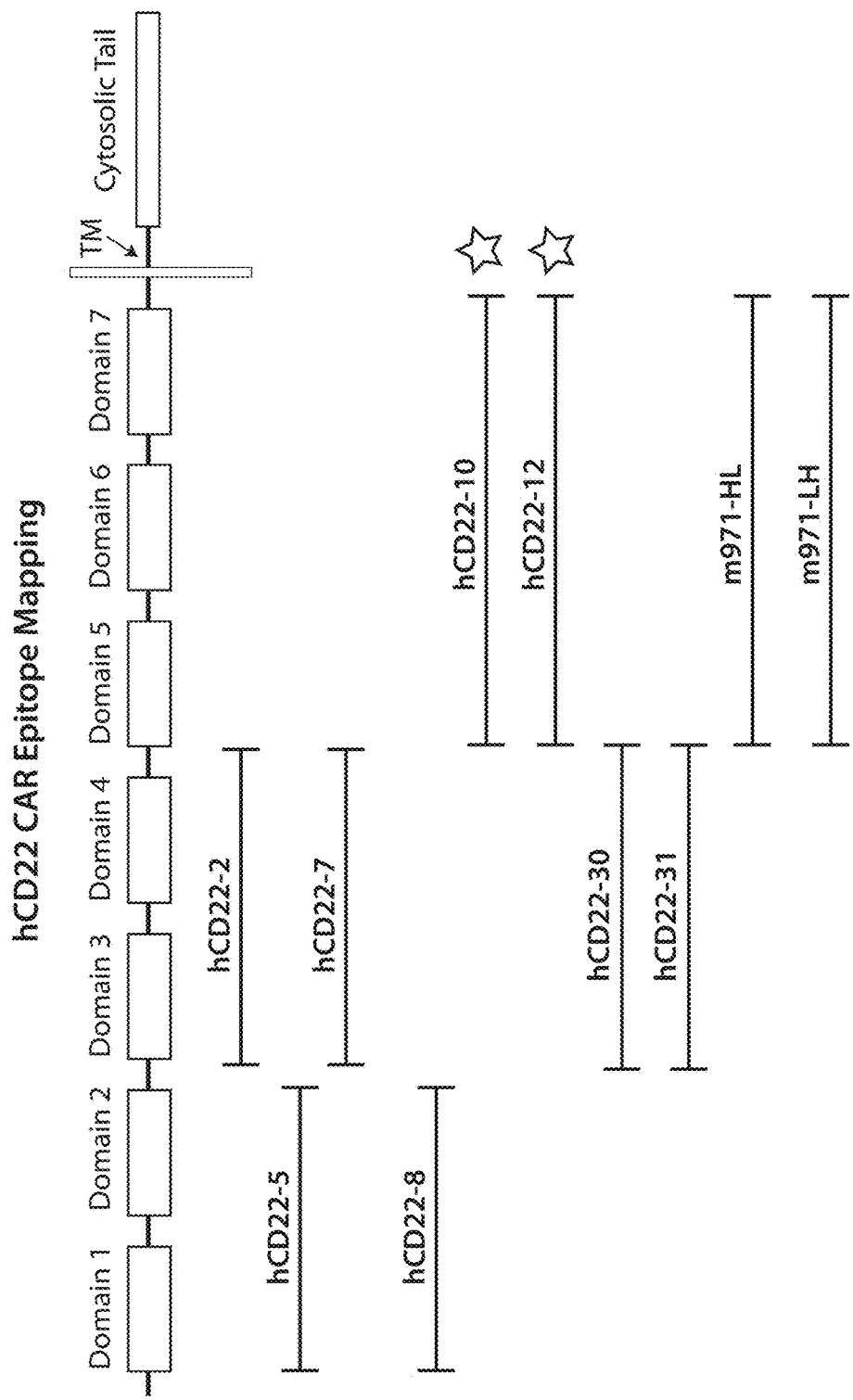
FIG. 75 is a diagram mapping the epitopes bound by various CD22 scFvs.

FIG. 72 is a graph showing the activation (in RLU) of several CD22 CAR-expressing JNL cells including CD22-57, CD22-58, CD22-59, CD22-60, CD22-61, CD22-62, and CD22-63, the scFv sequences of which are provided herein. Three different target proteins (CD22-FL-Fc, CD22-D567-Fc, and CD22-D67) were used to coat the tissue culture plates; a negative control (Fc) was also included. A mesothelin binding CAR (Meso-G07) was used as a negative control. CD22-12 and CD22-53 were used as positive controls. The experiment indicated that all CARs (CD22-57, CD22-58, CD22-59, CD22-60, CD22-61, CD22-62, and CD22-63) were functional in this assay. Furthermore, these results indicated that the CARs tested (including CD22-12 and -53) bind to the domains 6 and 7 of CD22. Domain mapping was performed on CD22 binding domains. Three different forms of antigens were used: CD22 full-length with all 7 external domains, Domain567 (in which domains 1-4 were deleted) and Domain67 (in which domains 1-5 were deleted). While not wishing to be bound by theory, it appears that the binding of various CD22 clones maps to the epitopes illustrated in FIG. 75.

Figure 73:
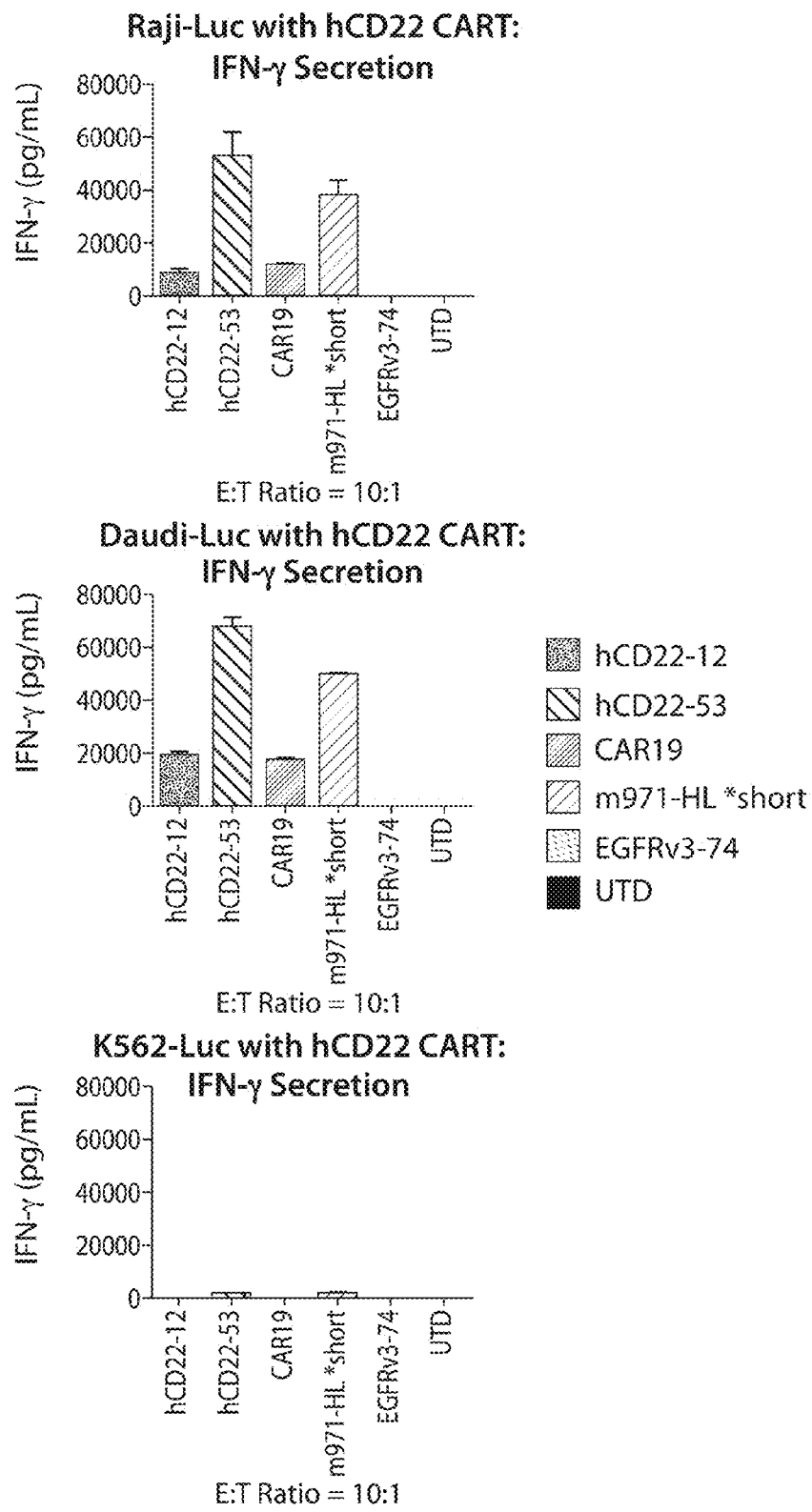
FIG. 73 shows three bar graphs indicating CD22 CAR activity in an IFN-gamma assay.

CD22 CAR constructs were also tested for the ability to promote secretion of IFN-gamma and IL-2. Briefly, transduced primary T cells from healthy donors expressing the different CD22 CARs were co-cultured with the CD22-positive target cells Raji-Luc and Daudi-Luc as well as the negative control K562-Luc. T cells and target cell were cultured in an effector-to-target cell ratio (E:T) of 10 to 1. Supernatants were harvested after 20-hr co-culture. FIG. 73 shows three bar graphs indicating IFN-gamma production in pg/mL. Co-culture with Raji-Luc (top panel) and Daudi-luc (center panel) cell lines induced IFN-gamma secretion by hCD22-12, hCD22-53 CAR T cells as well as the two positive controls CAR19 and m971-HL. Notably, highest amounts were observed when the hCD22-53 cells were tested, and to a lesser extent, when the hCD22-12 cells were tested. Similar results were observed when Nalm6-Luc, Pfeiffer-Luc, and K562-CD22-Luc, and SEM-Luc cells were tested (data not shown). Minimal IFN-gamma secretion was observed when the K562-Luc negative control cell line was tested (bottom panel).

Figure 74:
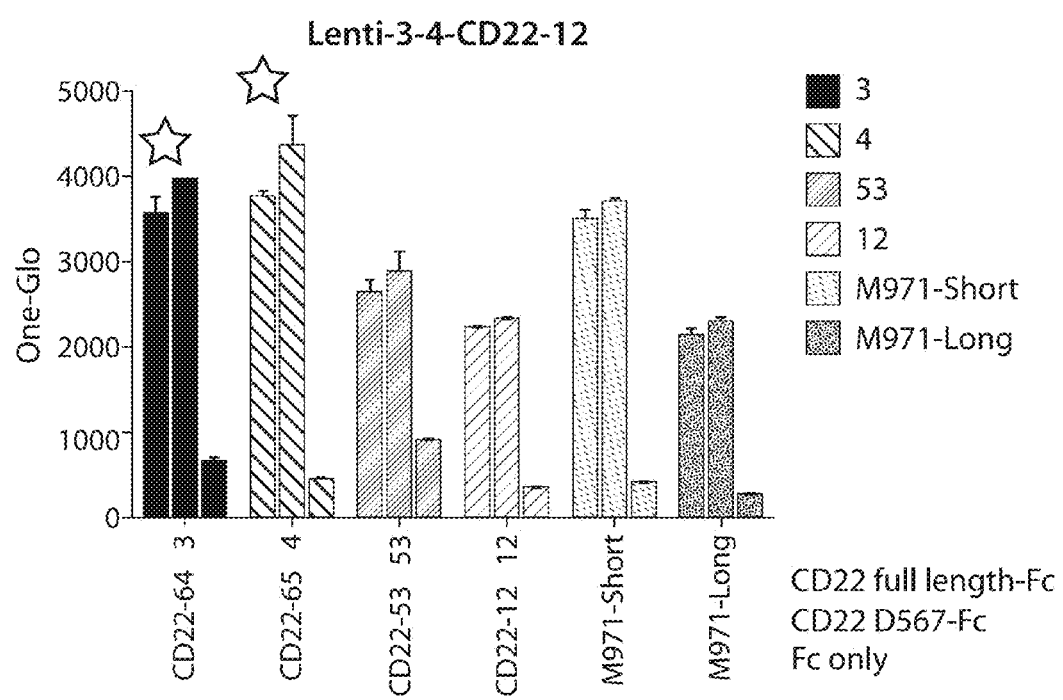
FIG. 74 shows binding activity of CD22-64 and CD22-65 CARs.

CD22-12 showed activity comparable to m971 in cell killing and cytokine secretion assays (Example 9). Two scFvs, named CD22-64 and CD22-65, were produced by affinity maturation of hCD22-12. CAR constructs containing these scFvs were tested for activity in an NFAT assay as described above. As shown in FIG. 74, both CD22-64 and CD22-65 bind CD22 as well or better than CD22-12 and CD22-53, leading to JNL activation. The bars in the figure represent, from left to right, CD22 full length-Fc; CD22 D567-Fc; and an Fc only negative control used for coating of the plates. Testing four variants of CD22-12 suggested that LCDR3 and HCDR3 contributed to binding to some extent (data not shown), and that HCDR3 may tolerate more mutations than LCDR3.

EQUIVALENTS

The disclosures of each and every patent, patent application, and publication cited herein are hereby incorporated herein by reference in their entirety. While this invention has been disclosed with reference to specific aspects, it is apparent that other aspects and variations of this invention may be devised by others skilled in the art without departing from the true spirit and scope of the invention. The appended claims are intended to be construed to include all such aspects and equivalent variations.

SEQUENCE LISTING (1529 sequences)

SEQ ID NO: 1 - protein, 242 aa, Artificial Sequence
  Description of Artificial Sequence: Synthetic polypeptide
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSS

SEQ ID NO: 2 - protein, 242 aa, Artificial Sequence
  Description of Artificial Sequence: Synthetic polypeptide
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSS

SEQ ID NO: 3 - protein, 242 aa, Artificial Sequence
  Description of Artificial Sequence: Synthetic polypeptide
QVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 4 - protein, 242 aa, Artificial Sequence
  Description of Artificial Sequence: Synthetic polypeptide
QVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 5 - protein, 247 aa, Artificial Sequence
  Description of Artificial Sequence: Synthetic polypeptide
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSS

SEQ ID NO: 6 - protein, 247 aa, Artificial Sequence
  Description of Artificial Sequence: Synthetic polypeptide
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSS

SEQ ID NO: 7 - protein, 247 aa, Artificial Sequence
  Description of Artificial Sequence: Synthetic polypeptide
QVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 8 - protein, 247 aa, Artificial Sequence
  Description of Artificial Sequence: Synthetic polypeptide
QVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 9 - protein, 247 aa, Artificial Sequence
  Description of Artificial Sequence: Synthetic polypeptide
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSS

SEQ ID NO: 10 - protein, 247 aa, Artificial Sequence
  Description of Artificial Sequence: Synthetic polypeptide
QVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 11 - protein, 242 aa, Artificial Sequence
  Description of Artificial Sequence: Synthetic polypeptide
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSS

SEQ ID NO: 12 - protein, 242 aa, Artificial Sequence
  Description of Artificial Sequence: Synthetic polypeptide
QVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 13 - protein, 21 aa, Artificial Sequence
  Description of Artificial Sequence: Synthetic peptide
MALPVTALLLPLALLLHAARP

SEQ ID NO: 14 - protein, 45 aa, Artificial Sequence
  Description of Artificial Sequence: Synthetic polypeptide
TTTPAPRPPTPAPTIASQPLSLRPEACRPAAGGAVHTRGLDFACD

SEQ ID NO: 15 - protein, 24 aa, Artificial Sequence
  Description of Artificial Sequence: Synthetic peptide
IYIWAPLAGTCGVLLLSLVITLYC

SEQ ID NO: 16 - protein, 42 aa, Artificial Sequence
  Description of Artificial Sequence: Synthetic polypeptide
KRGRKKLLYIFKQPFMRPVQTTQEEDGCSCRFPEEEEGGCEL

SEQ ID NO: 17 - protein, 112 aa, Artificial Sequence
  Description of Artificial Sequence: Synthetic polypeptide
RVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 18 - protein, 5 aa, Artificial Sequence
  Description of Artificial Sequence: Synthetic peptide
GGGGS

SEQ ID NO: 19 - protein, 10 aa, Artificial Sequence
  Description of Artificial Sequence: Synthetic peptide
GVSLPDYGVS

SEQ ID NO: 20 - protein, 16 aa, Artificial Sequence
  Description of Artificial Sequence: Synthetic peptide
VIWGSETTYYNSALKS

SEQ ID NO: 21 - protein, 16 aa, Artificial Sequence
  Description of Artificial Sequence: Synthetic peptide
VIWGSETTYYSSSLKS

SEQ ID NO: 22 - protein, 16 aa, Artificial Sequence
  Description of Artificial Sequence: Synthetic peptide
VIWGSETTYYQSSLKS

SEQ ID NO: 23 - protein, 16 aa, Artificial Sequence
  Description of Artificial Sequence: Synthetic peptide
VIWGSETTYYNSSLKS

SEQ ID NO: 24 - protein, 12 aa, Artificial Sequence
  Description of Artificial Sequence: Synthetic peptide
HYYYGGSYAMDY

SEQ ID NO: 25 - protein, 11 aa, Artificial Sequence
  Description of Artificial Sequence: Synthetic peptide
RASQDISKYLN

SEQ ID NO: 26 - protein, 7 aa, Artificial Sequence
  Description of Artificial Sequence: Synthetic peptide
HTSRLHS

SEQ ID NO: 27 - protein, 9 aa, Artificial Sequence
  Description of Artificial Sequence: Synthetic peptide
QQGNTLPYT

SEQ ID NO: 28 - DNA, 5000 bp, Artificial Sequence
  Description of Artificial Sequence: Synthetic polynucleotide
  misc_feature (1)..(5000): This sequence may encompass 50-5000 nucleotides
  See specification as filed for detailed description of substitutions and preferred embodiments
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 29 - DNA, 100 bp, Artificial Sequence
  Description of Artificial Sequence: Synthetic polynucleotide
tttttttttttttttttttttttttttttttttttttttttttttttttttttttttttttttttttttttttttttttttttttttttttttttttttt

SEQ ID NO: 30 - DNA, 5000 bp, Artificial Sequence
  Description of Artificial Sequence: Synthetic polynucleotide
  misc_feature (1)..(5000): This sequence may encompass 50-5000 nucleotides
  See specification as filed for detailed description of substitutions and preferred embodiments
tttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttt

SEQ ID NO: 31 - protein, 486 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 32 - protein, 486 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 33 - protein, 486 aa, Artificial Sequence
  Description of Artificial Sequence: Synthetic polypeptide
MALPVTALLLPLALLLHAARPQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 34 - protein, 486 aa, Artificial Sequence
  Description of Artificial Sequence: Synthetic polypeptide
MALPVTALLLPLALLLHAARPQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 35 - protein, 491 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 36 - protein, 491 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 37 - protein, 491 aa, Artificial Sequence
  Description of Artificial Sequence: Synthetic polypeptide
MALPVTALLLPLALLLHAARPQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 38 - protein, 491 aa, Artificial Sequence
  Description of Artificial Sequence: Synthetic polypeptide
MALPVTALLLPLALLLHAARPQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 39 - protein, 491 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 40 - protein, 491 aa, Artificial Sequence; identical to SEQ ID NO: 39
  Description of Artificial Sequence: Synthetic polypeptide

SEQ ID NO: 41 - protein, 491 aa, Artificial Sequence
  Description of Artificial Sequence: Synthetic polypeptide
MALPVTALLLPLALLLHAARPQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 42 - protein, 486 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 43 - protein, 112 aa, Artificial Sequence
  Description of Artificial Sequence: Synthetic polypeptide
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 44 - DNA, 336 bp, Artificial Sequence
  Description of Artificial Sequence: Synthetic polynucleotide
agagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 45 - protein, 230 aa, Artificial Sequence
  Description of Artificial Sequence: Synthetic polypeptide
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKM

SEQ ID NO: 46 - DNA, 690 bp, Artificial Sequence
  Description of Artificial Sequence: Synthetic polynucleotide
gagagcaagtacggccctccctgccccccttgccctgcccccgagttcctgggcggacccagcgtgttcctgttcccccccaagcccaaggacaccctgatgatcagccggacccccgaggtgacctgtgtggtggtggacgtgtcccaggaggaccccgaggtccagttcaactggtacgtggacggcgtggaggtgcacaacgccaagaccaagccccgggaggagcagttcaatagcacctaccgggtggtgtccgtgctgaccgtgctgcaccaggactggctgaacggcaaggaatacaagtgtaaggtgtccaacaagggcctgcccagcagcatcgagaaaaccatcagcaaggccaagggccagcctcgggagccccaggtgtacaccctgccccctagccaagaggagatgaccaagaaccaggtgtccctgacctgcctggtgaagggcttctaccccagcgacatcgccgtggagtgggagagcaacggccagcccgagaacaactacaagaccaccccccctgtgctggacagcgacggcagcttcttcctgtacagccggctgaccgtggacaagagccggtggcaggagggcaacgtctttagctgctccgtgatgcacgaggccctgcacaaccactacacccagaagagcctgagcctgtccctgggcaagatg

SEQ ID NO: 47 - protein, 282 aa, Artificial Sequence
  Description of Artificial Sequence: Synthetic polypeptide
RWPESPKAQASSVPTAQPQAEGSLAKATTAPATTRNTGRGGEEKKKEKEKEEQEERETKTPECPSHTQPLGVYLLTPAVQDLWLRDKATFTCFVVGSDLKDAHLTWEVAGKVPTGGVEEGLLERHSNGSQSQHSRLTLPRSLWNAGTSVTCTLNHPSLPPQRLMALREPAAQAPVKLSLNLLASSDPPEAASWLLCEVSGFSPPNILLMWLEDQREVNTSGFAPARPPPQPGSTTFWAWSVLRVPAPPSPQPATYTCVVSHEDSRTLLNASRSLEVSYVTDH

SEQ ID NO: 48 - DNA, 847 bp, Artificial Sequence
  Description of Artificial Sequence: Synthetic polynucleotide
aggtggcccgaaagtcccaaggcccaggcatctagtgttcctactgcacagccccaggcagaaggcagcctagccaaagctactactgcacctgccactacgcgcaatactggccgtggcggggaggagaagaaaaaggagaaagagaaagaagaacaggaagagagggagaccaagacccctgaatgtccatcccatacccagccgctgggcgtctatctcttgactcccgcagtacaggacttgtggcttagagataaggccacctttacatgtttcgtcgtgggctctgacctgaaggatgcccatttgacttgggaggttgccggaaaggtacccacagggggggttgaggaagggttgctggagcgccattccaatggctctcagagccagcactcaagactcacccttccgagatccctgtggaacgccgggacctctgtcacatgtactctaaatcatcctagcctgcccccacagcgtctgatggcccttagagagccagccgcccaggcaccagttaagcttagcctgaatctgctcgccagtagtgatcccccagaggccgccagctggctcttatgcgaagtgtccggctttagcccgcccaacatcttgctcatgtggctggaggaccagcgagaagtgaacaccagcggcttcgctccagcccggcccccaccccagccgggttctaccacattctgggcctggagtgtcttaagggtcccagcaccacctagcccccagccagccacatacacctgtgttgtgtcccatgaagatagcaggaccctgctaaatgcttctaggagtctggaggtttcctacgtgactgaccatt

SEQ ID NO: 49 - protein, 10 aa, Artificial Sequence
  Description of Artificial Sequence: Synthetic peptide
GGGGSGGGGS

SEQ ID NO: 50 - DNA, 30 bp, Artificial Sequence
  Description of Artificial Sequence: Synthetic oligonucleotide
ggtggcggaggttctggaggtggaggttcc

SEQ ID NO: 51 - protein, 48 aa, Artificial Sequence
  Description of Artificial Sequence: Synthetic polypeptide
QRRKYRSNKGESPVEPAEPCRYSCPREEEGSTIPIQEDYRKPEPACSP

SEQ ID NO: 52 - DNA, 123 bp, Artificial Sequence
  Description of Artificial Sequence: Synthetic polynucleotide
aggagtaagaggagcaggctcctgcacagtgactacatgaacatgactccccgccgccccgggcccacccgcaagcattaccagccctatgccccaccacgcgacttcgcagcctatcgctcc

SEQ ID NO: 53 - protein, 30 aa, Artificial Sequence
  Description of Artificial Sequence: Synthetic polypeptide
  MISC_FEATURE (1)..(30): This sequence may encompass 1-6 'Gly-Gly-Gly-Gly-Ser' repeating units
  See specification as filed for detailed description of substitutions and preferred embodiments
GGGGSGGGGSGGGGSGGGGSGGGGSGGGGS

SEQ ID NO: 54 - DNA, 63 bp, Artificial Sequence
  Description of Artificial Sequence: Synthetic oligonucleotide
atggccctgcctgtgacagccctgctgctgcctctggctctgctgctgcatgccgctagaccc

SEQ ID NO: 55 - DNA, 135 bp, Artificial Sequence
  Description of Artificial Sequence: Synthetic polynucleotide
accacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgat

SEQ ID NO: 56 - DNA, 72 bp, Artificial Sequence
  Description of Artificial Sequence: Synthetic oligonucleotide
atctacatctgggcgcccttggccgggacttgtggggtccttctcctgtcactggttatcaccctttactgc

SEQ ID NO: 57 - DNA, 5000 bp, Artificial Sequence; identical to SEQ ID NO: 28
  Description of Artificial Sequence: Synthetic polynucleotide
  misc_feature (1)..(5000): This sequence may encompass 100-5000 nucleotides
  See specification as filed for detailed description of substitutions and preferred embodiments

SEQ ID NO: 58 - protein, 486 aa, Artificial Sequence
  Description of Artificial Sequence: Synthetic polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 59 - protein, 242 aa, Artificial Sequence
  Description of Artificial Sequence: Synthetic polypeptide
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 60 - DNA, 126 bp, Artificial Sequence
  Description of Artificial Sequence: Synthetic polynucleotide
aaacggggcagaaagaaactcctgtatatattcaaacaaccatttatgagaccagtacaaactactcaagaggaagatggctgtagctgccgatttccagaagaagaagaaggaggatgtgaactg

SEQ ID NO: 61 - DNA, 813 bp, Artificial Sequence
  Description of Artificial Sequence: Synthetic polynucleotide
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactactcttcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagccaccaccatcatcaccatcaccat

SEQ ID NO: 62 - DNA, 813 bp, Artificial Sequence
  Description of Artificial Sequence: Synthetic polynucleotide
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactaccaatcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagccaccaccatcatcaccatcaccat

SEQ ID NO: 63 - DNA, 813 bp, Artificial Sequence
  Description of Artificial Sequence: Synthetic polynucleotide
atggctctgcccgtgaccgcactcctcctgccactggctctgctgcttcacgccgctcgcccacaagtccagcttcaagaatcagggcctggtctggtgaagccatctgagactctgtccctcacttgcaccgtgagcggagtgtccctcccagactacggagtgagctggattagacagcctcccggaaagggactggagtggatcggagtgatttggggtagcgaaaccacttactattcatcttccctgaagtcacgggtcaccatttcaaaggataactcaaagaatcaagtgagcctcaagctctcatcagtcaccgccgctgacaccgccgtgtattactgtgccaagcattactactatggagggtcctacgccatggactactggggccagggaactctggtcactgtgtcatctggtggaggaggtagcggaggaggcgggagcggtggaggtggctccgaaatcgtgatgacccagagccctgcaaccctgtccctttctcccggggaacgggctaccctttcttgtcgggcatcacaagatatctcaaaatacctcaattggtatcaacagaagccgggacaggcccctaggcttcttatctaccacacctctcgcctgcatagcgggattcccgcacgctttagcgggtctggaagcgggaccgactacactctgaccatctcatctctccagcccgaggacttcgccgtctacttctgccagcagggtaacaccctgccgtacaccttcggccagggcaccaagcttgagatcaaacatcaccaccatcatcaccatcac

SEQ ID NO: 64 - DNA, 813 bp, Artificial Sequence
  Description of Artificial Sequence: Synthetic polynucleotide
atggctctgcccgtgaccgcactcctcctgccactggctctgctgcttcacgccgctcgcccacaagtccagcttcaagaatcagggcctggtctggtgaagccatctgagactctgtccctcacttgcaccgtgagcggagtgtccctcccagactacggagtgagctggattagacagcctcccggaaagggactggagtggatcggagtgatttggggtagcgaaaccacttactatcaatcttccctgaagtcacgggtcaccatttcaaaggataactcaaagaatcaagtgagcctcaagctctcatcagtcaccgccgctgacaccgccgtgtattactgtgccaagcattactactatggagggtcctacgccatggactactggggccagggaactctggtcactgtgtcatctggtggaggaggtagcggaggaggcgggagcggtggaggtggctccgaaatcgtgatgacccagagccctgcaaccctgtccctttctcccggggaacgggctaccctttcttgtcgggcatcacaagatatctcaaaatacctcaattggtatcaacagaagccgggacaggcccctaggcttcttatctaccacacctctcgcctgcatagcgggattcccgcacgctttagcgggtctggaagcgggaccgactacactctgaccatctcatctctccagcccgaggacttcgccgtctacttctgccagcagggtaacaccctgccgtacaccttcggccagggcaccaagcttgagatcaaacatcaccaccatcatcaccatcac

SEQ ID NO: 65 - DNA, 828 bp, Artificial Sequence
  Description of Artificial Sequence: Synthetic polynucleotide
atggccctcccagtgaccgctctgctgctgcctctcgcacttcttctccatgccgctcggcctgagatcgtcatgacccaaagccccgctaccctgtccctgtcacccggcgagagggcaaccctttcatgcagggccagccaggacatttctaagtacctcaactggtatcagcagaagccagggcaggctcctcgcctgctgatctaccacaccagccgcctccacagcggtatccccgccagattttccgggagcgggtctggaaccgactacaccctcaccatctcttctctgcagcccgaggatttcgccgtctatttctgccagcaggggaatactctgccgtacaccttcggtcaaggtaccaagctggaaatcaagggaggcggaggatcaggcggtggcggaagcggaggaggtggctccggaggaggaggttcccaagtgcagcttcaagaatcaggacccggacttgtgaagccatcagaaaccctctccctgacttgtaccgtgtccggtgtgagcctccccgactacggagtctcttggattcgccagcctccggggaagggtcttgaatggattggggtgatttggggatcagagactacttactactcttcatcacttaagtcacgggtcaccatcagcaaagataatagcaagaaccaagtgtcacttaagctgtcatctgtgaccgccgctgacaccgccgtgtactattgtgccaaacattactattacggagggtcttatgctatggactactggggacaggggaccctggtgactgtctctagccatcaccatcaccaccatcatcac

SEQ ID NO: 66 - DNA, 828 bp, Artificial Sequence
  Description of Artificial Sequence: Synthetic polynucleotide
atggccctcccagtgaccgctctgctgctgcctctcgcacttcttctccatgccgctcggcctgagatcgtcatgacccaaagccccgctaccctgtccctgtcacccggcgagagggcaaccctttcatgcagggccagccaggacatttctaagtacctcaactggtatcagcagaagccagggcaggctcctcgcctgctgatctaccacaccagccgcctccacagcggtatccccgccagattttccgggagcgggtctggaaccgactacaccctcaccatctcttctctgcagcccgaggatttcgccgtctatttctgccagcaggggaatactctgccgtacaccttcggtcaaggtaccaagctggaaatcaagggaggcggaggatcaggcggtggcggaagcggaggaggtggctccggaggaggaggttcccaagtgcagcttcaagaatcaggacccggacttgtgaagccatcagaaaccctctccctgacttgtaccgtgtccggtgtgagcctccccgactacggagtctcttggattcgccagcctccggggaagggtcttgaatggattggggtgatttggggatcagagactacttactaccagtcatcacttaagtcacgggtcaccatcagcaaagataatagcaagaaccaagtgtcacttaagctgtcatctgtgaccgccgctgacaccgccgtgtactattgtgccaaacattactattacggagggtcttatgctatggactactggggacaggggaccctggtgactgtctctagccatcaccatcaccaccatcatcac

SEQ ID NO: 67 - DNA, 828 bp, Artificial Sequence
  Description of Artificial Sequence: Synthetic polynucleotide
atggcactgcctgtcactgccctcctgctgcctctggccctccttctgcatgccgccaggccccaagtccagctgcaagagtcaggacccggactggtgaagccgtctgagactctctcactgacttgtaccgtcagcggcgtgtccctccccgactacggagtgtcatggatccgccaacctcccgggaaagggcttgaatggattggtgtcatctggggttctgaaaccacctactactcatcttccctgaagtccagggtgaccatcagcaaggataattccaagaaccaggtcagccttaagctgtcatctgtgaccgctgctgacaccgccgtgtattactgcgccaagcactactattacggaggaagctacgctatggactattggggacagggcactctcgtgactgtgagcagcggcggtggagggtctggaggtggaggatccggtggtggtgggtcaggcggaggagggagcgagattgtgatgactcagtcaccagccaccctttctctttcacccggcgagagagcaaccctgagctgtagagccagccaggacatttctaagtacctcaactggtatcagcaaaaaccggggcaggcccctcgcctcctgatctaccatacctcacgccttcactctggtatccccgctcggtttagcggatcaggatctggtaccgactacactctgaccatttccagcctgcagccagaagatttcgcagtgtatttctgccagcagggcaatacccttccttacaccttcggtcagggaaccaagctcgaaatcaagcaccatcaccatcatcaccaccat

SEQ ID NO: 68 - DNA, 828 bp, Artificial Sequence
  Description of Artificial Sequence: Synthetic polynucleotide
atggcactgcctgtcactgccctcctgctgcctctggccctccttctgcatgccgccaggccccaagtccagctgcaagagtcaggacccggactggtgaagccgtctgagactctctcactgacttgtaccgtcagcggcgtgtccctccccgactacggagtgtcatggatccgccaacctcccgggaaagggcttgaatggattggtgtcatctggggttctgaaaccacctactaccagtcttccctgaagtccagggtgaccatcagcaaggataattccaagaaccaggtcagccttaagctgtcatctgtgaccgctgctgacaccgccgtgtattactgcgccaagcactactattacggaggaagctacgctatggactattggggacagggcactctcgtgactgtgagcagcggcggtggagggtctggaggtggaggatccggtggtggtgggtcaggcggaggagggagcgagattgtgatgactcagtcaccagccaccctttctctttcacccggcgagagagcaaccctgagctgtagagccagccaggacatttctaagtacctcaactggtatcagcaaaaaccggggcaggcccctcgcctcctgatctaccatacctcacgccttcactctggtatccccgctcggtttagcggatcaggatctggtaccgactacactctgaccatttccagcctgcagccagaagatttcgcagtgtatttctgccagcagggcaatacccttccttacaccttcggtcagggaaccaagctcgaaatcaagcaccatcaccatcatcatcaccac

SEQ ID NO: 69 - DNA, 828 bp, Artificial Sequence
  Description of Artificial Sequence: Synthetic polynucleotide
atggccctcccagtgaccgctctgctgctgcctctcgcacttcttctccatgccgctcggcctgagatcgtcatgacccaaagccccgctaccctgtccctgtcacccggcgagagggcaaccctttcatgcagggccagccaggacatttctaagtacctcaactggtatcagcagaagccagggcaggctcctcgcctgctgatctaccacaccagccgcctccacagcggtatccccgccagattttccgggagcgggtctggaaccgactacaccctcaccatctcttctctgcagcccgaggatttcgccgtctatttctgccagcaggggaatactctgccgtacaccttcggtcaaggtaccaagctggaaatcaagggaggcggaggatcaggcggtggcggaagcggaggaggtggctccggaggaggaggttcccaagtgcagcttcaagaatcaggacccggacttgtgaagccatcagaaaccctctccctgacttgtaccgtgtccggtgtgagcctccccgactacggagtctcttggattcgccagcctccggggaagggtcttgaatggattggggtgatttggggatcagagactacttactacaattcatcacttaagtcacgggtcaccatcagcaaagataatagcaagaaccaagtgtcacttaagctgtcatctgtgaccgccgctgacaccgccgtgtactattgtgccaaacattactattacggagggtcttatgctatggactactggggacaggggaccctggtgactgtctctagccatcaccatcaccaccatcatcac

SEQ ID NO: 70 - DNA, 828 bp, Artificial Sequence
  Description of Artificial Sequence: Synthetic polynucleotide
atggcactgcctgtcactgccctcctgctgcctctggccctccttctgcatgccgccaggccccaagtccagctgcaagagtcaggacccggactggtgaagccgtctgagactctctcactgacttgtaccgtcagcggcgtgtccctccccgactacggagtgtcatggatccgccaacctcccgggaaagggcttgaatggattggtgtcatctggggttctgaaaccacctactacaactcttccctgaagtccagggtgaccatcagcaaggataattccaagaaccaggtcagccttaagctgtcatctgtgaccgctgctgacaccgccgtgtattactgcgccaagcactactattacggaggaagctacgctatggactattggggacagggcactctcgtgactgtgagcagcggcggtggagggtctggaggtggaggatccggtggtggtgggtcaggcggaggagggagcgagattgtgatgactcagtcaccagccaccctttctctttcacccggcgagagagcaaccctgagctgtagagccagccaggacatttctaagtacctcaactggtatcagcaaaaaccggggcaggcccctcgcctcctgatctaccatacctcacgccttcactctggtatccccgctcggtttagcggatcaggatctggtaccgactacactctgaccatttccagcctgcagccagaagatttcgcagtgtatttctgccagcagggcaatacccttccttacaccttcggtcagggaaccaagctcgaaatcaagcaccatcaccatcatcaccaccat

SEQ ID NO: 71 - DNA, 813 bp, Artificial Sequence
  Description of Artificial Sequence: Synthetic polynucleotide
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactacaattcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagccaccaccatcatcaccatcaccat

SEQ ID NO: 72 - DNA, 813 bp, Artificial Sequence
  Description of Artificial Sequence: Synthetic polynucleotide
atggctctgcccgtgaccgcactcctcctgccactggctctgctgcttcacgccgctcgcccacaagtccagcttcaagaatcagggcctggtctggtgaagccatctgagactctgtccctcacttgcaccgtgagcggagtgtccctcccagactacggagtgagctggattagacagcctcccggaaagggactggagtggatcggagtgatttggggtagcgaaaccacttactataactcttccctgaagtcacgggtcaccatttcaaaggataactcaaagaatcaagtgagcctcaagctctcatcagtcaccgccgctgacaccgccgtgtattactgtgccaagcattactactatggagggtcctacgccatggactactggggccagggaactctggtcactgtgtcatctggtggaggaggtagcggaggaggcgggagcggtggaggtggctccgaaatcgtgatgacccagagccctgcaaccctgtccctttctcccggggaacgggctaccctttcttgtcgggcatcacaagatatctcaaaatacctcaattggtatcaacagaagccgggacaggcccctaggcttcttatctaccacacctctcgcctgcatagcgggattcccgcacgctttagcgggtctggaagcgggaccgactacactctgaccatctcatctctccagcccgaggacttcgccgtctacttctgccagcagggtaacaccctgccgtacaccttcggccagggcaccaagcttgagatcaaacatcaccaccatcatcaccatcac

SEQ ID NO: 73 - protein, 271 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSHHHHHHHH

SEQ ID NO: 74 - protein, 271 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSHHHHHHHH

SEQ ID NO: 75 - protein, 271 aa, Artificial Sequence
  Description of Artificial Sequence: Synthetic polypeptide
MALPVTALLLPLALLLHAARPQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKHHHHHHHH

SEQ ID NO: 76 - protein, 271 aa, Artificial Sequence
  Description of Artificial Sequence: Synthetic polypeptide
MALPVTALLLPLALLLHAARPQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKHHHHHHHH

SEQ ID NO: 77 - protein, 276 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSHHHHHHHH

SEQ ID NO: 78 - protein, 276 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSHHHHHHHH

SEQ ID NO: 79 - protein, 276 aa, Artificial Sequence
  Description of Artificial Sequence: Synthetic polypeptide
MALPVTALLLPLALLLHAARPQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKHHHHHHHH

SEQ ID NO: 80 - protein, 276 aa, Artificial Sequence
  Description of Artificial Sequence: Synthetic polypeptide
MALPVTALLLPLALLLHAARPQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKHHHHHHHH

SEQ ID NO: 81 - protein, 276 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSHHHHHHHH

SEQ ID NO: 82 - protein, 276 aa, Artificial Sequence
  Description of Artificial Sequence: Synthetic polypeptide
MALPVTALLLPLALLLHAARPQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKHHHHHHHH

SEQ ID NO: 83 - protein, 271 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSHHHHHHHH

SEQ ID NO: 84 - protein, 271 aa, Artificial Sequence
  Description of Artificial Sequence: Synthetic polypeptide
MALPVTALLLPLALLLHAARPQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKHHHHHHHH

SEQ ID NO: 85 - DNA, 1458 bp, Artificial Sequence
  Description of Artificial Sequence: Synthetic polynucleotide
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactactcttcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 86 - DNA, 1458 bp, Artificial Sequence
  Description of Artificial Sequence: Synthetic polynucleotide
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactaccaatcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 87 - DNA, 1458 bp, Artificial Sequence
  Description of Artificial Sequence: Synthetic polynucleotide
atggctctgcccgtgaccgcactcctcctgccactggctctgctgcttcacgccgctcgcccacaagtccagcttcaagaatcagggcctggtctggtgaagccatctgagactctgtccctcacttgcaccgtgagcggagtgtccctcccagactacggagtgagctggattagacagcctcccggaaagggactggagtggatcggagtgatttggggtagcgaaaccacttactattcatcttccctgaagtcacgggtcaccatttcaaaggataactcaaagaatcaagtgagcctcaagctctcatcagtcaccgccgctgacaccgccgtgtattactgtgccaagcattactactatggagggtcctacgccatggactactggggccagggaactctggtcactgtgtcatctggtggaggaggtagcggaggaggcgggagcggtggaggtggctccgaaatcgtgatgacccagagccctgcaaccctgtccctttctcccggggaacgggctaccctttcttgtcgggcatcacaagatatctcaaaatacctcaattggtatcaacagaagccgggacaggcccctaggcttcttatctaccacacctctcgcctgcatagcgggattcccgcacgctttagcgggtctggaagcgggaccgactacactctgaccatctcatctctccagcccgaggacttcgccgtctacttctgccagcagggtaacaccctgccgtacaccttcggccagggcaccaagcttgagatcaaaaccactactcccgctccaaggccacccacccctgccccgaccatcgcctctcagccgctttccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 88 - DNA, 1458 bp, Artificial Sequence
  Description of Artificial Sequence: Synthetic polynucleotide
atggctctgcccgtgaccgcactcctcctgccactggctctgctgcttcacgccgctcgcccacaagtccagcttcaagaatcagggcctggtctggtgaagccatctgagactctgtccctcacttgcaccgtgagcggagtgtccctcccagactacggagtgagctggattagacagcctcccggaaagggactggagtggatcggagtgatttggggtagcgaaaccacttactatcaatcttccctgaagtcacgggtcaccatttcaaaggataactcaaagaatcaagtgagcctcaagctctcatcagtcaccgccgctgacaccgccgtgtattactgtgccaagcattactactatggagggtcctacgccatggactactggggccagggaactctggtcactgtgtcatctggtggaggaggtagcggaggaggcgggagcggtggaggtggctccgaaatcgtgatgacccagagccctgcaaccctgtccctttctcccggggaacgggctaccctttcttgtcgggcatcacaagatatctcaaaatacctcaattggtatcaacagaagccgggacaggcccctaggcttcttatctaccacacctctcgcctgcatagcgggattcccgcacgctttagcgggtctggaagcgggaccgactacactctgaccatctcatctctccagcccgaggacttcgccgtctacttctgccagcagggtaacaccctgccgtacaccttcggccagggcaccaagcttgagatcaaaaccactactcccgctccaaggccacccacccctgccccgaccatcgcctctcagccgctttccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 89 - DNA, 1473 bp, Artificial Sequence
  Description of Artificial Sequence: Synthetic polynucleotide
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagcggcggaggcgggagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactactcttcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 90 - DNA, 1473 bp, Artificial Sequence
  Description of Artificial Sequence: Synthetic polynucleotide
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagcggaggcggagggagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactaccaatcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 91 - DNA, 1473 bp, Artificial Sequence
  Description of Artificial Sequence: Synthetic polynucleotide
atggctctgcccgtgaccgcactcctcctgccactggctctgctgcttcacgccgctcgcccacaagtccagcttcaagaatcagggcctggtctggtgaagccatctgagactctgtccctcacttgcaccgtgagcggagtgtccctcccagactacggagtgagctggattagacagcctcccggaaagggactggagtggatcggagtgatttggggtagcgaaaccacttactattcatcttccctgaagtcacgggtcaccatttcaaaggataactcaaagaatcaagtgagcctcaagctctcatcagtcaccgccgctgacaccgccgtgtattactgtgccaagcattactactatggagggtcctacgccatggactactggggccagggaactctggtcactgtgtcatctggtggaggaggtagcggaggaggcgggagcggtggaggtggctccggaggtggcggaagcgaaatcgtgatgacccagagccctgcaaccctgtccctttctcccggggaacgggctaccctttcttgtcgggcatcacaagatatctcaaaatacctcaattggtatcaacagaagccgggacaggcccctaggcttcttatctaccacacctctcgcctgcatagcgggattcccgcacgctttagcgggtctggaagcgggaccgactacactctgaccatctcatctctccagcccgaggacttcgccgtctacttctgccagcagggtaacaccctgccgtacaccttcggccagggcaccaagcttgagatcaaaaccactactcccgctccaaggccacccacccctgccccgaccatcgcctctcagccgctttccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 92 - DNA, 1473 bp, Artificial Sequence
  Description of Artificial Sequence: Synthetic polynucleotide
atggctctgcccgtgaccgcactcctcctgccactggctctgctgcttcacgccgctcgcccacaagtccagcttcaagaatcagggcctggtctggtgaagccatctgagactctgtccctcacttgcaccgtgagcggagtgtccctcccagactacggagtgagctggattagacagcctcccggaaagggactggagtggatcggagtgatttggggtagcgaaaccacttactatcaatcttccctgaagtcacgggtcaccatttcaaaggataactcaaagaatcaagtgagcctcaagctctcatcagtcaccgccgctgacaccgccgtgtattactgtgccaagcattactactatggagggtcctacgccatggactactggggccagggaactctggtcactgtgtcatctggtggaggaggtagcggaggaggcgggagcggtggaggtggctccggaggcggtgggtcagaaatcgtgatgacccagagccctgcaaccctgtccctttctcccggggaacgggctaccctttcttgtcgggcatcacaagatatctcaaaatacctcaattggtatcaacagaagccgggacaggcccctaggcttcttatctaccacacctctcgcctgcatagcgggattcccgcacgctttagcgggtctggaagcgggaccgactacactctgaccatctcatctctccagcccgaggacttcgccgtctacttctgccagcagggtaacaccctgccgtacaccttcggccagggcaccaagcttgagatcaaaaccactactcccgctccaaggccacccacccctgccccgaccatcgcctctcagccgctttccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 93 - DNA, 1473 bp, Artificial Sequence
  Description of Artificial Sequence: Synthetic polynucleotide
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagcggaggcggtgggagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactacaactcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 94 - DNA, 1473 bp, Artificial Sequence; identical to SEQ ID NO: 93
  Description of Artificial Sequence: Synthetic polynucleotide

SEQ ID NO: 95 - DNA, 1473 bp, Artificial Sequence
  Description of Artificial Sequence: Synthetic polynucleotide
atggctctgcccgtgaccgcactcctcctgccactggctctgctgcttcacgccgctcgcccacaagtccagcttcaagaatcagggcctggtctggtgaagccatctgagactctgtccctcacttgcaccgtgagcggagtgtccctcccagactacggagtgagctggattagacagcctcccggaaagggactggagtggatcggagtgatttggggtagcgaaaccacttactataactcttccctgaagtcacgggtcaccatttcaaaggataactcaaagaatcaagtgagcctcaagctctcatcagtcaccgccgctgacaccgccgtgtattactgtgccaagcattactactatggagggtcctacgccatggactactggggccagggaactctggtcactgtgtcatctggtggaggaggtagcggaggaggcgggagcggtggaggtggctccggaggtggcggaagcgaaatcgtgatgacccagagccctgcaaccctgtccctttctcccggggaacgggctaccctttcttgtcgggcatcacaagatatctcaaaatacctcaattggtatcaacagaagccgggacaggcccctaggcttcttatctaccacacctctcgcctgcatagcgggattcccgcacgctttagcgggtctggaagcgggaccgactacactctgaccatctcatctctccagcccgaggacttcgccgtctacttctgccagcagggtaacaccctgccgtacaccttcggccagggcaccaagcttgagatcaaaaccactactcccgctccaaggccacccacccctgccccgaccatcgcctctcagccgctttccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 96 - DNA, 1458 bp, Artificial Sequence
  Description of Artificial Sequence: Synthetic polynucleotide
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactacaactcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 97 - DNA, 813 bp, Artificial Sequence
  Description of Artificial Sequence: Synthetic polynucleotide
atggccctgcccgtcaccgctctgctgctgccccttgctctgcttcttcatgcagcaaggccggacatccagatgacccaaaccacctcatccctctctgcctctcttggagacagggtgaccatttcttgtcgcgccagccaggacatcagcaagtatctgaactggtatcagcagaagccggacggaaccgtgaagctcctgatctaccatacctctcgcctgcatagcggcgtgccctcacgcttctctggaagcggatcaggaaccgattattctctcactatttcaaatcttgagcaggaagatattgccacctatttctgccagcagggtaataccctgccctacaccttcggaggagggaccaagctcgaaatcaccggtggaggaggcagcggcggtggagggtctggtggaggtggttctgaggtgaagctgcaagaatcaggccctggacttgtggccccttcacagtccctgagcgtgacttgcaccgtgtccggagtctccctgcccgactacggagtgtcatggatcagacaacctccacggaaaggactggaatggctcggtgtcatctggggtagcgaaactacttactacaattcagccctcaaaagcaggctgactattatcaaggacaacagcaagtcccaagtctttcttaagatgaactcactccagactgacgacaccgcaatctactattgtgctaagcactactactacggaggatcctacgctatggattactggggacaaggtacttccgtcactgtctcttcacaccatcatcaccatcaccatcac

SEQ ID NO: 98 - protein, 271 aa, Artificial Sequence
  Description of Artificial Sequence: Synthetic polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSHHHHHHHH

SEQ ID NO: 99 - DNA, 1458 bp, Artificial Sequence
  Description of Artificial Sequence: Synthetic polynucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 100 - DNA, 1184 bp, Artificial Sequence
  Description of Artificial Sequence: Synthetic polynucleotide
cgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtga

SEQ ID NO: 101 - DNA, 336 bp, Artificial Sequence
  Description of Artificial Sequence: Synthetic polynucleotide
agagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 102 - protein, 230 aa, Artificial Sequence; identical to SEQ ID NO: 45
  Description of Artificial Sequence: Synthetic polypeptide

SEQ ID NO: 103 - DNA, 690 bp, Artificial Sequence; identical to SEQ ID NO: 46
  Description of Artificial Sequence: Synthetic polynucleotide

SEQ ID NO: 104 - DNA, 400 bp, Artificial Sequence
  Description of Artificial Sequence: Synthetic polynucleotide
  Misc_Feature (1)..(400): This sequence may encompass 100-400 nucleotides
  See specification as filed for detailed description of substitutions and preferred embodiments
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 105 - protein, 40 aa, Artificial Sequence
  Description of Artificial Sequence: Synthetic polypeptide
  MISC_FEATURE (1)..(40): This sequence may encompass 1-10 'Gly-Gly-Gly-Ser' repeating units
  See specification as filed for detailed description of substitutions and preferred embodiments
GGGSGGGSGGGSGGGSGGGSGGGSGGGSGGGSGGGSGGGS

SEQ ID NO: 106 - protein, 20 aa, Artificial Sequence
  Description of Artificial Sequence: Synthetic peptide
GGGGSGGGGSGGGGSGGGGS

SEQ ID NO: 107 - protein, 15 aa, Artificial Sequence
  Description of Artificial Sequence: Synthetic peptide
GGGGSGGGGSGGGGS

SEQ ID NO: 108 - protein, 4 aa, Artificial Sequence
  Description of Artificial Sequence: Synthetic peptide
GGGS

SEQ ID NO: 109 - protein, 244 aa, Artificial Sequence
  Description of Artificial Sequence: Synthetic polypeptide
QVQLLESGAELVRPGSSVKISCKASGYAFSSYWMNWVKQRPGQGLEWIGQIYPGDGDTNYNGKFKGQATLTADKSSSTAYMQLSGLTSEDSAVYSCARKTISSVVDFYFDYWGQGTTVTGGGSGGGSGGGSGGGSELVLTQSPKFMSTSVGDRVSVTCKASQNVGTNVAWYQQKPGQSPKPLIYSATYRNSGVPDRFTGSGSGTDFTLTITNVQSKDLADYFCQYNRYPYTSFFFTKLEIKRRS

SEQ ID NO: 110 - protein, 464 aa, Artificial Sequence
  Description of Artificial Sequence: Synthetic polypeptide
QVQLLESGAELVRPGSSVKISCKASGYAFSSYWMNWVKQRPGQGLEWIGQIYPGDGDTNYNGKFKGQATLTADKSSSTAYMQLSGLTSEDSAVYSCARKTISSVVDFYFDYWGQGTTVTGGGSGGGSGGGSGGGSELVLTQSPKFMSTSVGDRVSVTCKASQNVGTNVAWYQQKPGQSPKPLIYSATYRNSGVPDRFTGSGSGTDFTLTITNVQSKDLADYFCQYNRYPYTSFFFTKLEIKRRSKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 111 - protein, 246 aa, Artificial Sequence
  Description of Artificial Sequence: Synthetic polypeptide
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSE

SEQ ID NO: 112 - protein, 439 aa, Artificial Sequence
  Description of Artificial Sequence: Synthetic polypeptide
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSESKYGPPCPPCPMFWVLVVVGGVLACYSLLVTVAFIIFWVKRGRKKLLYIFKQPFMRPVQTTQEEDGCSCRFEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRL

SEQ ID NO: 113 - protein, 819 aa, Artificial Sequence
  Description of Artificial Sequence: Synthetic polypeptide
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSESKYGPPCPPCPMFWVLVVVGGVLACYSLLVTVAFIIFWVKRGRKKLLYIFKQPFMRPVQTTQEEDGCSCRFEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRLEGGGEGRGSLLTCGDVEENPGPRMLLLVTSLLLCELPHPAFLLIPRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFM

SEQ ID NO: 114 - protein, 245 aa, Artificial Sequence
  Description of Artificial Sequence: Synthetic polypeptide
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 115 - protein, 467 aa, Artificial Sequence
  Description of Artificial Sequence: Synthetic polypeptide
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 116 - DNA, 735 bp, Artificial Sequence
  Description of Artificial Sequence: Synthetic polynucleotide
gaagtgcaacttgtggaatctggtggaggacttgtgcaacctggaagatcactgagactgtcatgtgcagcctcggggtttaccttcgacgactacgccatgcactgggtgcgccaggctccggggaagggcctcgaatgggtgtcgggcatcagctggaactccggttccattggctatgcggactccgtgaaaggacgcttcacaatttcccgggataacgccaagaacagcctgtacttgcagatgaactccctgcgggccgaggataccgccctgtactactgcgctaaggacaagggcggtggatactacgacttctggagcggaagcgactactggggacagggaactctggtcaccgtgtcctccggcggagggggctccggcggcggtggtagcgggggtggagggtcgtcgtcggagctgacccaggaccccgcagtgtccgtcgccctggggcagactgtgcggatcacttgccaaggagacagcctgcggtcctactacgcgtcctggtatcagcagaagccggggcaggccccagtcctcgtcatctacggaaagaacaataggcccagcggaatccctgaccgcttctcgggctcatcctccggcaacaccgcctccctgaccatcacgggcgcgcaggccgaggacgaagccgattactactgcaactcacgggattccagcggatgggtgttcggaggaggaaccaagctcactgtgctc

SEQ ID NO: 117 - DNA, 744 bp, Artificial Sequence
  Description of Artificial Sequence: Synthetic polynucleotide
caagtccaactcgtccagtccggtgcagaagtcaagaaacccggagcttccgtgaaagtgtcctgcaaggcctcggggtataccttcacttcctactacatgcactgggtccggcaggcgccgggacagggactggaatggatgggtatcatcaacccctcgggcggttccactagctacgcccagaagttccagggaagagtgaccatgacccgggacacttccacttcgaccgtgtacatggaactgagcagcctgaggagcgaggacaccgccgtgtactactgtgcccggcccgagggagtgtcctactacgattcctccgtgctggattactggggacagggaacacttgtgaccgtgtcctcgggaggaggcggaagcgggggcggagggtctgggggaggcggctcccagtccgctctgacgcagcctgcgtccgtgtccgggagccctggccagagcattactatttcatgcaccggtaccagctccgacgtgggcggatataagcacgtgtcatggtaccagcatcacccgggaaaggccccaaagctgatgatctacgacgtgtcgaacagaccgagcggggtgtcaaatcgcttttccggttcaaagtcgggcaacactgcctcactcaccgtgtcgggcctccaagcggaggacgaagcccactactactgcgtgtcctaccgcaacttcaactccttggtgttcggcaccggcaccaaggtcaccgtcctg

SEQ ID NO: 118 - DNA, 2000 bp, Artificial Sequence
  Description of Artificial Sequence: Synthetic polynucleotide
  misc_feature (1)..(2000): This sequence may encompass 50-2000 nucleotides
  See specification as filed for detailed description of substitutions and preferred embodiments
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 119 - protein, 373 aa, Artificial Sequence
  Description of Artificial Sequence: Synthetic polypeptide
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 120 - DNA, 1182 bp, Artificial Sequence
  Description of Artificial Sequence: Synthetic polynucleotide
atggccctccctgtcactgccctgcttctccccctcgcactcctgctccacgccgctagaccacccggatggtttctggactctccggatcgcccgtggaatcccccaaccttctcaccggcactcttggttgtgactgagggcgataatgcgaccttcacgtgctcgttctccaacacctccgaatcattcgtgctgaactggtaccgcatgagcccgtcaaaccagaccgacaagctcgccgcgtttccggaagatcggtcgcaaccgggacaggattgtcggttccgcgtgactcaactgccgaatggcagagacttccacatgagcgtggtccgcgctaggcgaaacgactccgggacctacctgtgcggagccatctcgctggcgcctaaggcccaaatcaaagagagcttgagggccgaactgagagtgaccgagcgcagagctgaggtgccaactgcacatccatccccatcgcctcggcctgcggggcagtttcagaccctggtcacgaccactccggcgccgcgcccaccgactccggccccaactatcgcgagccagcccctgtcgctgaggccggaagcatgccgccctgccgccggaggtgctgtgcatacccggggattggacttcgcatgcgacatctacatttgggctcctctcgccggaacttgtggcgtgctccttctgtccctggtcatcaccctgtactgcaagcggggtcggaaaaagcttctgtacattttcaagcagcccttcatgaggcccgtgcaaaccacccaggaggaggacggttgctcctgccggttccccgaagaggaagaaggaggttgcgagctgcgcgtgaagttctcccggagcgccgacgcccccgcctataagcagggccagaaccagctgtacaacgaactgaacctgggacggcgggaagagtacgatgtgctggacaagcggcgcggccgggaccccgaaatgggcgggaagcctagaagaaagaaccctcaggaaggcctgtataacgagctgcagaaggacaagatggccgaggcctactccgaaattgggatgaagggagagcggcggaggggaaaggggcacgacggcctgtaccaaggactgtccaccgccaccaaggacacatacgatgccctgcacatgcaggcccttccccctcgc

SEQ ID NO: 121 - protein, 394 aa, Artificial Sequence
  Description of Artificial Sequence: Synthetic polypeptide
MALPVTALLLPLALLLHAARPPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 122 - protein, 132 aa, Artificial Sequence
  Description of Artificial Sequence: Synthetic polypeptide
DVPDYASLGGPSSPKKKRKVSRGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLETSY

SEQ ID NO: 123 - protein, 108 aa, Artificial Sequence
  Description of Artificial Sequence: Synthetic polypeptide
VQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLETS

SEQ ID NO: 124 - protein, 93 aa, Artificial Sequence [sequence omitted]

SEQ ID NO: 125 - protein, 95 aa, Artificial Sequence
  Description of Artificial Sequence: Synthetic polypeptide
ILWHEMWHEGLIEASRLYFGERNVKGMFEVLEPLHAMMERGPQTLKETSFNQAYGRDLMEAQEWCRKYMKSGNVKDLTQAWDLYYHVFRRISKTS

SEQ ID NO: 126 - protein, 95 aa, Artificial Sequence
  Description of Artificial Sequence: Synthetic polypeptide
ILWHEMWHEGLLEASRLYFGERNVKGMFEVLEPLHAMMERGPQTLKETSFNQAYGRDLMEAQEWCRKYMKSGNVKDLTQAWDLYYHVFRRISKTS

SEQ ID NO: 127 - protein, 95 aa, Artificial Sequence
  Description of Artificial Sequence: Synthetic polypeptide
ILWHEMWHEGLEEASRLYFGERNVKGMFEVLEPLHAMMERGPQTLKETSFNQAYGRDLMEAQEWCRKYMKSGNVKDLLQAWDLYYHVFRRISKTS

SEQ ID NO: 128 - protein, 95 aa, Artificial Sequence
  Description of Artificial Sequence: Synthetic polypeptide
  MOD_RES (12)..(12): Any amino acid
  MOD_RES (78)..(78): Any amino acid
ILWHEMWHEGLXEASRLYFGERNVKGMFEVLEPLHAMMERGPQTLKETSFNQAYGRDLMEAQEWCRKYMKSGNVKDLXQAWDLYYHVFRRISKTS

SEQ ID NO: 129 - protein, 95 aa, Artificial Sequence
  Description of Artificial Sequence: Synthetic polypeptide
ILWHEMWHEGLIEASRLYFGERNVKGMFEVLEPLHAMMERGPQTLKETSFNQAYGRDLMEAQEWCRKYMKSGNVKDLLQAWDLYYHVFRRISKTS

SEQ ID NO: 130 - protein, 95 aa, Artificial Sequence
  Description of Artificial Sequence: Synthetic polypeptide
ILWHEMWHEGLLEASRLYFGERNVKGMFEVLEPLHAMMERGPQTLKETSFNQAYGRDLMEAQEWCRKYMKSGNVKDLLQAWDLYYHVFRRISKTS

SEQ ID NO: 131 - protein, 254 aa, Homo sapiens
EVQLQQSGPGLVKPSQTLSLTCAISGDSVSSNSAAWNWIRQSPSRGLEWLGRTYYRSKWYSDYAVSVKSRITINPDTSKNQFSLQLNSVTPEDTAVYYCARDPYDFWSGYPDAFDIWGQGTMVTVSSGGGGSGGGGSGGGGSQSALTQPASVSGSPGQSITISCTGTSSDVGGYNYVSWYQQHPGKAPKVIISEVNNRPSGVSHRFSGSKSGNTASLTISGLQAEDEADYFCSSYTSGRTLYVFGTGSKVTVLG

SEQ ID NO: 132 - protein, 251 aa, Homo sapiens
EVQLQQSGPGLVKPSQTLSLTCAISGDSVSNNNAAWNWIRQSPSRGLEWLGRTYHRSTWYNDYVGSVKSRITINPDTSKNQFSLQLNSVTPEDTAVYYCARETDYGDYGAFDIWGQGTTVTVSSGGGGSGGGGSGGGGSQSALTQPASVSGSPGQSITISCTGSRNDIGAYESVSWYQQHPGNAPKLIIHGVNNRPSGVFDRFSVSQSGNTASLTISGLQAEDEADYYCSSHTTTSTLYVFGTGTKVTVLG

SEQ ID NO: 133 - protein, 247 aa, Homo sapiens
EVQLQQSGPGLVNPSQTLSITCAISGDSVSSNSAAWNWIRQSPSRGLEWLGRTFYRSKWYNDYAVSVKGRITISPDTSKNQFSLQLNSVTPEDTAVYYCAGGDYYYGLDVWGQGTTVTVSSGGGGSGGGGSGGGGSQSALTQPASVSGSPGQSITISCTGSSSDVGGYNSVSWYQQHPGKAPKLMIYEVINRPSGVSHRFSGSKSGNTASLTISGLQAEDEADYYCSSYTSSSTYVFGTGTKVTVLG

SEQ ID NO: 134 - protein, 254 aa, Homo sapiens
EVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSGGGGSGGGGSGGGGSQSALTQPASVSGSPGQSITISCTGSSSDIGGFNYVSWYQQHAGEAPKLMIYEVTNRPSGVSDRFSGSKSDNTASLTISGLQAEDEADYYCSSYASGSPLYVFGTGTKVTVLG

SEQ ID NO: 135 - protein, 254 aa, Homo sapiens
EVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSGGGGSGGGGSGSGGSQSALTQPASVSGSPGQSITFSCTGTSSDIGGYNYVSWYQQHPGKAPKLMIYEVSNRPSGVSNRFSGTKSGNTASLTISGLQAEDEADYYCSSYTSSSTLYVFGTGTKLTVLG

SEQ ID NO: 136 - protein, 254 aa, Homo sapiens
QVQLQESGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSGGGGSGGGGSGSGGSQSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLYVFGTGTKVTVLG

SEQ ID NO: 137 - protein, 254 aa, Homo sapiens
EVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLYVFGTGTKVTVLG

SEQ ID NO: 138 - protein, 254 aa, Homo sapiens
EVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSGGGGSGGGGSGGGGSQSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLYIFGTGTKVTVLG

SEQ ID NO: 139 - protein, 253 aa, Homo sapiens
EVQLQQSGPGLVKPSQTLPLTCAISGDSVLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSGGGGSGGGGSGGGGPQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVL

SEQ ID NO: 140 - protein, 253 aa, Homo sapiens
EVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSGGGGSGGGGSGGGGSQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVL

SEQ ID NO: 141 - protein, 15 aa, Artificial Sequence
  Description of Artificial Sequence: Synthetic peptide
  MOD_RES (1)..(1): Any amino acid
XRLQDGNSWSDAFDV

SEQ ID NO: 142 - protein, 12 aa, Artificial Sequence
  Description of Artificial Sequence: Synthetic peptide
GDSVSSNSAAWN

SEQ ID NO: 143 - protein, 10 aa, Artificial Sequence
  Description of Artificial Sequence: Synthetic peptide
GFTVSSNYMS

SEQ ID NO: 144 - protein, 12 aa, Artificial Sequence
  Description of Artificial Sequence: Synthetic peptide
GDSVSSNSAAWN

SEQ ID NO: 145 - protein, 12 aa, Artificial Sequence
  Description of Artificial Sequence: Synthetic peptide
GDSVLSNSDTWN

SEQ ID NO: 146 - protein, 10 aa, Artificial Sequence
  Description of Artificial Sequence: Synthetic peptide
GFTFDDYAMH

SEQ ID NO: 147 - protein, 10 aa, Artificial Sequence
  Description of Artificial Sequence: Synthetic peptide
GFTFDDYAMH

SEQ ID NO: 148 - protein, 12 aa, Artificial Sequence
  Description of Artificial Sequence: Synthetic peptide
GDSVSSNSATWT

SEQ ID NO: 149 - protein, 10 aa, Artificial Sequence
  Description of Artificial Sequence: Synthetic peptide
GYTFTGYYMH

SEQ ID NO: 150 - protein, 10 aa, Artificial Sequence
  Description of Artificial Sequence: Synthetic peptide
GYTFTSYGIS

SEQ ID NO: 151 - protein, 10 aa, Artificial Sequence
  Description of Artificial Sequence: Synthetic peptide
GFTFSNAWMN

SEQ ID NO: 152 - protein, 12 aa, Artificial Sequence
  Description of Artificial Sequence: Synthetic peptide
GDSVLSNSDTWN

SEQ ID NO: 153 - protein, 12 aa, Artificial Sequence
  Description of Artificial Sequence: Synthetic peptide
GDSVSSNSAAWN

SEQ ID NO: 154 - protein, 12 aa, Artificial Sequence
  Description of Artificial Sequence: Synthetic peptide
GDSVLSNSDTWN

SEQ ID NO: 155 - protein, 12 aa, Artificial Sequence
  Description of Artificial Sequence: Synthetic peptide
GGSISSSSYYWG

SEQ ID NO: 156 - protein, 10 aa, Artificial Sequence
  Description of Artificial Sequence: Synthetic peptide
GYTFTSYYMH

SEQ ID NO: 157 - protein, 10 aa, Artificial Sequence
  Description of Artificial Sequence: Synthetic peptide
GFTFSSYAMH

SEQ ID NO: 158 - protein, 10 aa, Artificial Sequence
  Description of Artificial Sequence: Synthetic peptide
GYTFTSYYMH

SEQ ID NO: 159 - protein, 10 aa, Artificial Sequence
  Description of Artificial Sequence: Synthetic peptide
GFTFSSYAMS

SEQ ID NO: 160 - protein, 10 aa, Artificial Sequence
  Description of Artificial Sequence: Synthetic peptide
GYTFTSYYMH

SEQ ID NO: 161 - protein, 10 aa, Artificial Sequence
  Description of Artificial Sequence: Synthetic peptide
GYTFTSYYMH

SEQ ID NO: 162 - protein, 10 aa, Artificial Sequence
  Description of Artificial Sequence: Synthetic peptide
GYTFTSYYMH

SEQ ID NO: 163 - protein, 10 aa, Artificial Sequence
  Description of Artificial Sequence: Synthetic peptide
GYTFTSYYMH

SEQ ID NO: 164 - protein, 10 aa, Artificial Sequence
  Description of Artificial Sequence: Synthetic peptide
GGTFSSYAIS

SEQ ID NO: 165 - protein, 10 aa, Artificial Sequence
  Description of Artificial Sequence: Synthetic peptide
GYTFTSYYMH

SEQ ID NO: 166 - protein, 10 aa, Artificial Sequence
  Description of Artificial Sequence: Synthetic peptide
GFTFSSYAMS

SEQ ID NO: 167 - protein, 10 aa, Artificial Sequence
  Description of Artificial Sequence: Synthetic peptide
GYTFTSYYMH

SEQ ID NO: 168 - protein, 10 aa, Artificial Sequence
  Description of Artificial Sequence: Synthetic peptide
GYSFTGSWIG

SEQ ID NO: 169 - protein, 10 aa, Artificial Sequence
  Description of Artificial Sequence: Synthetic peptide
GGSINSYYWS

SEQ ID NO: 170 - protein, 10 aa, Artificial Sequence
  Description of Artificial Sequence: Synthetic peptide
GFTFSDYYMS

SEQ ID NO: 171 - protein, 10 aa, Artificial Sequence
  Description of Artificial Sequence: Synthetic peptide
GYTFTSYYMH

SEQ ID NO: 172 - protein, 10 aa, Artificial Sequence
  Description of Artificial Sequence: Synthetic peptide
GYTFTGYYMH

SEQ ID NO: 173 - protein, 10 aa, Artificial Sequence
  Description of Artificial Sequence: Synthetic peptide
GYTFTSYDIN

SEQ ID NO: 174 - protein, 10 aa, Artificial Sequence
  Description of Artificial Sequence: Synthetic peptide
GYTFTSYGIS

SEQ ID NO: 175 - protein, 12 aa, Artificial Sequence
  Description of Artificial Sequence: Synthetic peptide
GFSLNTFGMSVS

SEQ ID NO: 176 - protein, 11 aa, Artificial Sequence
  Description of Artificial Sequence: Synthetic peptide
GASITSRHWWN

SEQ ID NO: 177 - protein, 10 aa, Artificial Sequence
  Description of Artificial Sequence: Synthetic peptide
GYTFTSYYMH

SEQ ID NO: 178 - protein, 10 aa, Artificial Sequence
  Description of Artificial Sequence: Synthetic peptide
GYTFTSYYMH

SEQ ID NO: 179 - protein, 10 aa, Artificial Sequence
  Description of Artificial Sequence: Synthetic peptide
GYTFTSYYMH

SEQ ID NO: 180 - protein, 10 aa, Artificial Sequence
  Description of Artificial Sequence: Synthetic peptide
GYTFTSYYMH

SEQ ID NO: 181 - protein, 18 aa, Artificial Sequence
  Description of Artificial Sequence: Synthetic peptide
RTYYRSKWYNDYAVSVKS

SEQ ID NO: 182 - protein, 16 aa, Artificial Sequence
  Description of Artificial Sequence: Synthetic peptide
VIYSGGSTYYADSVKG

SEQ ID NO: 183 - protein, 18 aa, Artificial Sequence
  Description of Artificial Sequence: Synthetic peptide
RTYYRSKWYNDYAVSVKS

SEQ ID NO: 184 - protein, 18 aa, Artificial Sequence
  Description of Artificial Sequence: Synthetic peptide
RTYHRSTWYDDYASSVRG

SEQ ID NO: 185 - protein, 17 aa, Artificial Sequence
  Description of Artificial Sequence: Synthetic peptide
GISWNSGSIGYADSVKG

SEQ ID NO: 186 - protein, 17 aa, Artificial Sequence
  Description of Artificial Sequence: Synthetic peptide
GISWNSGSIGYADSVKG

SEQ ID NO: 187 - protein, 18 aa, Artificial Sequence
  Description of Artificial Sequence: Synthetic peptide
RTYYRSTWYNDYAVSVKS

SEQ ID NO: 188 - protein, 17 aa, Artificial Sequence
  Description of Artificial Sequence: Synthetic peptide
WINPNSGGTNYAQKFQG

SEQ ID NO: 189 - protein, 17 aa, Artificial Sequence
  Description of Artificial Sequence: Synthetic peptide
WISAYNGNTNYAQKLQG

SEQ ID NO: 190 - protein, 19 aa, Artificial Sequence
  Description of Artificial Sequence: Synthetic peptide
RIKSKTDGGTADYAAPVKG

SEQ ID NO: 191 - protein, 18 aa, Artificial Sequence
  Description of Artificial Sequence: Synthetic peptide
RTYHRSTWYDDYASSVRG

SEQ ID NO: 192 - protein, 18 aa, Artificial Sequence
  Description of Artificial Sequence: Synthetic peptide
RTYYRSKWYNDYAVSVKS

SEQ ID NO: 193 - protein, 18 aa, Artificial Sequence
  Description of Artificial Sequence: Synthetic peptide
RTYHRSTWYDDYASSVRG

SEQ ID NO: 194 - protein, 16 aa, Artificial Sequence
  Description of Artificial Sequence: Synthetic peptide
SIYYSGSTYYNPSLKS

SEQ ID NO: 195 - protein, 17 aa, Artificial Sequence
  Description of Artificial Sequence: Synthetic peptide
IINPSGGSTSYAQKFQG

SEQ ID NO: 196 - protein, 17 aa, Artificial Sequence
  Description of Artificial Sequence: Synthetic peptide
AISSNGGSTYYANSVKD

SEQ ID NO: 197 - protein, 17 aa, Artificial Sequence
  Description of Artificial Sequence: Synthetic peptide
IINPSGGSTSYAQKFQG

SEQ ID NO: 198 - protein, 17 aa, Artificial Sequence
  Description of Artificial Sequence: Synthetic peptide
AISGSGGSTYYADSVKG

SEQ ID NO: 199 - protein, 17 aa, Artificial Sequence
  Description of Artificial Sequence: Synthetic peptide
IINPSGGSTSYAQKFQG

SEQ ID NO: 200 - DNA, 9211 bp, Artificial Sequence
  Description of Artificial Sequence: Synthetic polynucleotide
gtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgattagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattgggggggtacagtgcaggggaaagaatagtagacataatagcaacagacatacaaactaaagaattacaaaaacaaattacaaaaattcaaaattttcgggtttattacagggacagcagagatccagtttggctgcatacgcgtcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccactgagtaccgggcgccgtccaggcacctcgattagttctcgtgcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgagctagctctagagccaccatggccctgcctgtgacagccctgctgctgcctctggctctgctgctgcatgccgctagacccggatcccaggtgcagctgcagcagtctggacccggcctcgtgaagcctagccagaccctgtctctgacctgcgccatcagcggcgatagcgtgtccagcaatagcgccgcctggaactggatcagacagagccctagcagaggcctggaatggctgggccggacctactaccggtccaagtggtacaacgactacgccgtgtccgtgaagtcccggatcaccatcaaccccgacaccagcaagaaccagttctccctgcagctgaacagcgtgacccccgaggataccgccgtgtactactgcgccagagaagtgaccggcgacctggaagatgccttcgacatctggggccagggcacaatggtcaccgtgtctagcggaggcggaggatctggcggcggaggaagtggcggagggggatctgggggaggcggaagcgatatccagatgacccagagccccagctccctgtctgccagcgtgggcgacagagtgaccatcacctgtagggccagccagaccatctggtcctacctgaactggtatcagcagcggcctggcaaggcccccaacctgctgatctatgccgccagctctctgcagtccggcgtgcccagcagattttccggcagaggctccggcaccgacttcaccctgacaatcagttccctgcaggccgaggacttcgccacctactactgccagcagagctacagcatcccccagaccttcggccaggggaccaagctggaaatcaagtccggaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagtcgacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccagttccgcccattctccgccccatggctgactaattttttttatttatgcagaggccgaggccgcctcggcctctgagctattccagaagtagtgaggaggcttttttggaggcctaggcttttgcgtcgagacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgg

SEQ ID NO: 201 - protein, 235 aa, Artificial Sequence
  Description of Artificial Sequence: Synthetic polypeptide
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVSHKPSNTKVDKKVEPKSCDKTSGQAG

SEQ ID NO: 202 - protein, 214 aa, Artificial Sequence
  Description of Artificial Sequence: Synthetic polypeptide
DIQMTQSPSSLSASVGDRVTITCRASQTIWSYLNWYQQRPGKAPNLLIYAASSLQSGVPSRFSGRGSGTDFTLTISSLQAEDFATYYCQQSYSIPQTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 203 - protein, 251 aa, Artificial Sequence
  Description of Artificial Sequence: Synthetic polypeptide
QVQLVQSGGGLIQPGGSLRLSCAASGFTVSSNYMSWVRQAPGKGLEWVSVIYSGGSTYYADSVKGRFTISRDNSKNTLYLQMNSLRAEDTAVYYCASQSTPYDSSGYYSGDAFDIWGQGTMVTVSSGGGGSGGGGSGGGGSSYVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGYVFGTGTKLTVL

SEQ ID NO: 204 - DNA, 753 bp, Artificial Sequence
  Description of Artificial Sequence: Synthetic polynucleotide
caagtgcaactcgtccaatccggcggcggactgattcaaccaggaggttcccttagactctcatgtgccgctagcggattcactgtgtcctcaaactacatgagctgggtccgccaggcgcccggaaagggcctggaatgggtgtccgtgatctactcgggcggatcaacctactacgccgattccgtgaaggggcggttcaccatctcgcgggataactccaagaacaccctgtacttgcaaatgaactcactgagggccgaagataccgccgtctactactgcgcgagccagtccactccctacgactcgagcgggtactactccggggacgccttcgacatctggggacagggaactatggtcacggtgtcgtcgggaggagggggcagcggcggcggaggaagcgggggagggggttcgtcctatgtgctgacccagccgccgagcgcctccgggactccgggccagcgcgtgaccatttcctgctccggctcctcatccaacatcggttcgaattatgtgtactggtaccagcagctgcctggtactgcccctaagcttctcatctaccggaacaaccagcgcccgtctggcgtgcccgaccggttctccggctcgaagtccggcaccagcgcctccctggctatctccgggctgagatccgaggatgaggccgactactattgcgcagcgtgggacgacagcctgtcgggatacgtgtttggaaccggaaccaagctcaccgtgctg

SEQ ID NO: 205 - DNA, 846 bp, Artificial Sequence
  Description of Artificial Sequence: Synthetic polynucleotide
atggccctccctgtcaccgccctgctgcttccgctggctcttctgctccacgccgctcggccccaagtgcaactcgtccaatccggcggcggactgattcaaccaggaggttcccttagactctcatgtgccgctagcggattcactgtgtcctcaaactacatgagctgggtccgccaggcgcccggaaagggcctggaatgggtgtccgtgatctactcgggcggatcaacctactacgccgattccgtgaaggggcggttcaccatctcgcgggataactccaagaacaccctgtacttgcaaatgaactcactgagggccgaagataccgccgtctactactgcgcgagccagtccactccctacgactcgagcgggtactactccggggacgccttcgacatctggggacagggaactatggtcacggtgtcgtcgggaggagggggcagcggcggcggaggaagcgggggagggggttcgtcctatgtgctgacccagccgccgagcgcctccgggactccgggccagcgcgtgaccatttcctgctccggctcctcatccaacatcggttcgaattatgtgtactggtaccagcagctgcctggtactgcccctaagcttctcatctaccggaacaaccagcgcccgtctggcgtgcccgaccggttctccggctcgaagtccggcaccagcgcctccctggctatctccgggctgagatccgaggatgaggccgactactattgcgcagcgtgggacgacagcctgtcgggatacgtgtttggaaccggaaccaagctcaccgtgctgggatcgcaccaccatcaccatcatcatcac

SEQ ID NO: 206 - protein, 282 aa, Artificial Sequence
  Description of Artificial Sequence: Synthetic polypeptide
MALPVTALLLPLALLLHAARPQVQLVQSGGGLIQPGGSLRLSCAASGFTVSSNYMSWVRQAPGKGLEWVSVIYSGGSTYYADSVKGRFTISRDNSKNTLYLQMNSLRAEDTAVYYCASQSTPYDSSGYYSGDAFDIWGQGTMVTVSSGGGGSGGGGSGGGGSSYVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGYVFGTGTKLTVLGSHHHHHHHH

SEQ ID NO: 207 - protein, 495 aa, Artificial Sequence
  Description of Artificial Sequence: Synthetic polypeptide
MALPVTALLLPLALLLHAARPQVQLVQSGGGLIQPGGSLRLSCAASGFTVSSNYMSWVRQAPGKGLEWVSVIYSGGSTYYADSVKGRFTISRDNSKNTLYLQMNSLRAEDTAVYYCASQSTPYDSSGYYSGDAFDIWGQGTMVTVSSGGGGSGGGGSGGGGSSYVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGYVFGTGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 208 - DNA, 1485 bp, Artificial Sequence
  Description of Artificial Sequence: Synthetic polynucleotide
atggccctccctgtcaccgccctgctgcttccgctggctcttctgctccacgccgctcggccccaagtgcaactcgtccaatccggcggcggactgattcaaccaggaggttcccttagactctcatgtgccgctagcggattcactgtgtcctcaaactacatgagctgggtccgccaggcgcccggaaagggcctggaatgggtgtccgtgatctactcgggcggatcaacctactacgccgattccgtgaaggggcggttcaccatctcgcgggataactccaagaacaccctgtacttgcaaatgaactcactgagggccgaagataccgccgtctactactgcgcgagccagtccactccctacgactcgagcgggtactactccggggacgccttcgacatctggggacagggaactatggtcacggtgtcgtcgggaggagggggcagcggcggcggaggaagcgggggagggggttcgtcctatgtgctgacccagccgccgagcgcctccgggactccgggccagcgcgtgaccatttcctgctccggctcctcatccaacatcggttcgaattatgtgtactggtaccagcagctgcctggtactgcccctaagcttctcatctaccggaacaaccagcgcccgtctggcgtgcccgaccggttctccggctcgaagtccggcaccagcgcctccctggctatctccgggctgagatccgaggatgaggccgactactattgcgcagcgtgggacgacagcctgtcgggatacgtgtttggaaccggaaccaagctcaccgtgctgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 209 - protein, 251 aa, Artificial Sequence
  Description of Artificial Sequence: Synthetic polypeptide
EVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARDLGWIAVAGTFDYWGQGTLVTVSSGGGGSGGGGSGGGGSQSALTQPASVSGSPGQSITISCTGTSSDVGGYNYVSWYQQHPGKAPKLMIYDVSKRPSGVSNRFSGSKSGNTASLTISGLQAEDEADYYCSSYTSSSLNHVFGTGTKVTVL

SEQ ID NO: 210 - DNA, 753 bp, Artificial Sequence
  Description of Artificial Sequence: Synthetic polynucleotide
gaagtgcaactccaacagagcggacccggacttgtgaaaccatcccagactctcagcctgacgtgtgcgatcagcggggactctgtgtcctccaactccgccgcctggaactggattaggcagtcgccgtcgagagggctggagtggttgggtagaacctactaccggtccaagtggtacaatgactacgccgtgtccgtgaagtcccggatcactattaacccggatacctcaaagaaccagttctccctgcaactgaactcggtgacccctgaggacaccgcagtgtactactgcgcccgggatctgggttggatcgctgtcgccggcaccttcgactattggggacagggcactctcgtgaccgtgtcgtcgggtggaggagggagcggagggggcggaagcggtggcggcggttcccagtccgcgctgacccagcctgctagcgtgtccgggtcgcccggacagtcaatcaccatctcctgcactgggactagcagcgacgtgggcggctacaactacgtgtcatggtaccagcagcacccgggaaaggcgcccaagctgatgatctacgacgtgtccaagcgcccttcgggagtctccaaccgctttagcggctccaagtcgggcaacactgcctccctgaccattagcggactgcaggccgaagatgaggccgactattactgctcatcctacacctcctcctcactgaaccatgtgttcggcaccggaaccaaggtcacagtcctc

SEQ ID NO: 211 - DNA, 846 bp, Artificial Sequence
  Description of Artificial Sequence: Synthetic polynucleotide
atggccctccctgtcaccgccctgctgcttccgctggctcttctgctccacgccgctcggcccgaagtgcaactccaacagagcggacccggacttgtgaaaccatcccagactctcagcctgacgtgtgcgatcagcggggactctgtgtcctccaactccgccgcctggaactggattaggcagtcgccgtcgagagggctggagtggttgggtagaacctactaccggtccaagtggtacaatgactacgccgtgtccgtgaagtcccggatcactattaacccggatacctcaaagaaccagttctccctgcaactgaactcggtgacccctgaggacaccgcagtgtactactgcgcccgggatctgggttggatcgctgtcgccggcaccttcgactattggggacagggcactctcgtgaccgtgtcgtcgggtggaggagggagcggagggggcggaagcggtggcggcggttcccagtccgcgctgacccagcctgctagcgtgtccgggtcgcccggacagtcaatcaccatctcctgcactgggactagcagcgacgtgggcggctacaactacgtgtcatggtaccagcagcacccgggaaaggcgcccaagctgatgatctacgacgtgtccaagcgcccttcgggagtctccaaccgctttagcggctccaagtcgggcaacactgcctccctgaccattagcggactgcaggccgaagatgaggccgactattactgctcatcctacacctcctcctcactgaaccatgtgttcggcaccggaaccaaggtcacagtcctcggatcgcaccaccatcaccatcatcatcac

SEQ ID NO: 212 - protein, 282 aa, Artificial Sequence
  Description of Artificial Sequence: Synthetic polypeptide
MALPVTALLLPLALLLHAARPEVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARDLGWIAVAGTFDYWGQGTLVTVSSGGGGSGGGGSGGGGSQSALTQPASVSGSPGQSITISCTGTSSDVGGYNYVSWYQQHPGKAPKLMIYDVSKRPSGVSNRFSGSKSGNTASLTISGLQAEDEADYYCSSYTSSSLNHVFGTGTKVTVLGSHHHHHHHH

SEQ ID NO: 213 - protein, 495 aa, Artificial Sequence
  Description of Artificial Sequence: Synthetic polypeptide
MALPVTALLLPLALLLHAARPEVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARDLGWIAVAGTFDYWGQGTLVTVSSGGGGSGGGGSGGGGSQSALTQPASVSGSPGQSITISCTGTSSDVGGYNYVSWYQQHPGKAPKLMIYDVSKRPSGVSNRFSGSKSGNTASLTISGLQAEDEADYYCSSYTSSSLNHVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 214 - DNA, 1485 bp, Artificial Sequence
  Description of Artificial Sequence: Synthetic polynucleotide
atggccctccctgtcaccgccctgctgcttccgctggctcttctgctccacgccgctcggcccgaagtgcaactccaacagagcggacccggacttgtgaaaccatcccagactctcagcctgacgtgtgcgatcagcggggactctgtgtcctccaactccgccgcctggaactggattaggcagtcgccgtcgagagggctggagtggttgggtagaacctactaccggtccaagtggtacaatgactacgccgtgtccgtgaagtcccggatcactattaacccggatacctcaaagaaccagttctccctgcaactgaactcggtgacccctgaggacaccgcagtgtactactgcgcccgggatctgggttggatcgctgtcgccggcaccttcgactattggggacagggcactctcgtgaccgtgtcgtcgggtggaggagggagcggagggggcggaagcggtggcggcggttcccagtccgcgctgacccagcctgctagcgtgtccgggtcgcccggacagtcaatcaccatctcctgcactgggactagcagcgacgtgggcggctacaactacgtgtcatggtaccagcagcacccgggaaaggcgcccaagctgatgatctacgacgtgtccaagcgcccttcgggagtctccaaccgctttagcggctccaagtcgggcaacactgcctccctgaccattagcggactgcaggccgaagatgaggccgactattactgctcatcctacacctcctcctcactgaaccatgtgttcggcaccggaaccaaggtcacagtcctcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 215 - protein, 253 aa, Artificial Sequence
  Description of Artificial Sequence: Synthetic polypeptide
EVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGAYYCARDRLQDGNSWSDAFDVWGQGTMVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTPYVFGTGTQLTVL

SEQ ID NO: 216 - DNA, 759 bp, Artificial Sequence
  Description of Artificial Sequence: Synthetic polynucleotide
gaagtgcaactccaacagagcggacccggacttgtgaaaccttcccaaactctctccctgacctgtgcgatctctggggattcggtgctgtcgaatagcgacacctggaactggatcagacagtcaccctcccggggcctggagtggctcgggagaacttaccaccggtccacttggtacgacgactatgccagctcagtgcgcggaagggtgtccattaacgtggacacctccaagaaccagtacagcctgcagttgaacgctgtgaccccggaagataccggagcctactactgcgcccgcgaccggctgcaggacggaaactcctggtccgatgccttcgacgtctggggccagggaaccatggtcactgtgtcatccggcggtggcggttcgggcggtggtggcagcggtggaggcggctcccagtcggcactgactcagccagcttcagtctccggctcgccgggacagtccatcaccatttcctgcactggaaccagctccgatgtcggggggtataactacgtgtcgtggtaccagcaacatcctggaaaggcccccaagctcatgatctacgacgtgtccaatcgccctagcggagtgtcaaaccggttttccggctccaagtccgggaacaccgcgtccctgacaatcagcggactgcaggccgaggacgaagccgactactactgctcgagctacaccagctcgtccacgccgtacgtgttcggaactgggacccagctgaccgtgctg

SEQ ID NO: 217 - DNA, 852 bp, Artificial Sequence
  Description of Artificial Sequence: Synthetic polynucleotide
atggccctccctgtcaccgccctgctgcttccgctggctcttctgctccacgccgctcggcccgaagtgcaactccaacagagcggacccggacttgtgaaaccttcccaaactctctccctgacctgtgcgatctctggggattcggtgctgtcgaatagcgacacctggaactggatcagacagtcaccctcccggggcctggagtggctcgggagaacttaccaccggtccacttggtacgacgactatgccagctcagtgcgcggaagggtgtccattaacgtggacacctccaagaaccagtacagcctgcagttgaacgctgtgaccccggaagataccggagcctactactgcgcccgcgaccggctgcaggacggaaactcctggtccgatgccttcgacgtctggggccagggaaccatggtcactgtgtcatccggcggtggcggttcgggcggtggtggcagcggtggaggcggctcccagtcggcactgactcagccagcttcagtctccggctcgccgggacagtccatcaccatttcctgcactggaaccagctccgatgtcggggggtataactacgtgtcgtggtaccagcaacatcctggaaaggcccccaagctcatgatctacgacgtgtccaatcgccctagcggagtgtcaaaccggttttccggctccaagtccgggaacaccgcgtccctgacaatcagcggactgcaggccgaggacgaagccgactactactgctcgagctacaccagctcgtccacgccgtacgtgttcggaactgggacccagctgaccgtgctgggatcgcaccaccatcaccatcatcatcac

SEQ ID NO: 218 - protein, 284 aa, Artificial Sequence
  Description of Artificial Sequence: Synthetic polypeptide
MALPVTALLLPLALLLHAARPEVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGAYYCARDRLQDGNSWSDAFDVWGQGTMVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTPYVFGTGTQLTVLGSHHHHHHHH

SEQ ID NO: 219 - protein, 497 aa, Artificial Sequence
  Description of Artificial Sequence: Synthetic polypeptide
MALPVTALLLPLALLLHAARPEVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGAYYCARDRLQDGNSWSDAFDVWGQGTMVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTPYVFGTGTQLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 220 - DNA, 1491 bp, Artificial Sequence
  Description of Artificial Sequence: Synthetic polynucleotide
atggccctccctgtcaccgccctgctgcttccgctggctcttctgctccacgccgctcggcccgaagtgcaactccaacagagcggacccggacttgtgaaaccttcccaaactctctccctgacctgtgcgatctctggggattcggtgctgtcgaatagcgacacctggaactggatcagacagtcaccctcccggggcctggagtggctcgggagaacttaccaccggtccacttggtacgacgactatgccagctcagtgcgcggaagggtgtccattaacgtggacacctccaagaaccagtacagcctgcagttgaacgctgtgaccccggaagataccggagcctactactgcgcccgcgaccggctgcaggacggaaactcctggtccgatgccttcgacgtctggggccagggaaccatggtcactgtgtcatccggcggtggcggttcgggcggtggtggcagcggtggaggcggctcccagtcggcactgactcagccagcttcagtctccggctcgccgggacagtccatcaccatttcctgcactggaaccagctccgatgtcggggggtataactacgtgtcgtggtaccagcaacatcctggaaaggcccccaagctcatgatctacgacgtgtccaatcgccctagcggagtgtcaaaccggttttccggctccaagtccgggaacaccgcgtccctgacaatcagcggactgcaggccgaggacgaagccgactactactgctcgagctacaccagctcgtccacgccgtacgtgttcggaactgggacccagctgaccgtgctgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 221 - protein, 246 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKGLSSWHFHDALDIWGQGTMVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRDSSGNHLWVFGGGTKLTVL

SEQ ID NO: 222 - DNA, 738 bp, Artificial Sequence
  Description of Artificial Sequence: Synthetic polynucleotide
gaagtgcagttggtggaatcaggaggaggacttgtgcaacctggaagatctctcagactctcgtgtgcggcctccggtttcaccttcgacgactacgccatgcattgggtcagacaggccccgggaaagggcctggagtgggtgtcaggcatctcatggaacagcggctccattggctacgccgactcggtcaagggaaggttcactatctcccgggacaacgccaagaactccctgtacctccaaatgaacagcctgcgcgccgaggatactgccctgtactactgcgccaaggggctgtccagctggcactttcacgacgcacttgatatctggggacagggtaccatggtcaccgtgtcctccggtggcggaggctcagggggaggaggaagcgggggcggtggttcctcctccgaactgacccaggacccggccgtgtccgtggcgctgggacaaaccgtgcgcattacttgccagggcgacagcttgcggtcgtactacgcctcgtggtaccagcagaagcccggccaggctcccgtgctggtcatctatggcaaaaacaaccgcccgagcggaattccagaccggttctccgggagctcgtccgggaacaccgcttcgctcaccatcacgggggcccaggcggaggacgaagcagattactactgcaactcgcgggattccagcggcaatcacctctgggtgttcgggggcggaaccaagctgactgtgctg

SEQ ID NO: 223 - DNA, 831 bp, Artificial Sequence
  Description of Artificial Sequence: Synthetic polynucleotide
atggccctccctgtcaccgccctgctgcttccgctggctcttctgctccacgccgctcggcccgaagtgcagttggtggaatcaggaggaggacttgtgcaacctggaagatctctcagactctcgtgtgcggcctccggtttcaccttcgacgactacgccatgcattgggtcagacaggccccgggaaagggcctggagtgggtgtcaggcatctcatggaacagcggctccattggctacgccgactcggtcaagggaaggttcactatctcccgggacaacgccaagaactccctgtacctccaaatgaacagcctgcgcgccgaggatactgccctgtactactgcgccaaggggctgtccagctggcactttcacgacgcacttgatatctggggacagggtaccatggtcaccgtgtcctccggtggcggaggctcagggggaggaggaagcgggggcggtggttcctcctccgaactgacccaggacccggccgtgtccgtggcgctgggacaaaccgtgcgcattacttgccagggcgacagcttgcggtcgtactacgcctcgtggtaccagcagaagcccggccaggctcccgtgctggtcatctatggcaaaaacaaccgcccgagcggaattccagaccggttctccgggagctcgtccgggaacaccgcttcgctcaccatcacgggggcccaggcggaggacgaagcagattactactgcaactcgcgggattccagcggcaatcacctctgggtgttcgggggcggaaccaagctgactgtgctgggatcgcaccaccatcaccatcatcatcac

SEQ ID NO: 224 - protein, 277 aa, Artificial Sequence
  Description of Artificial Sequence: Synthetic polypeptide
MALPVTALLLPLALLLHAARPEVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKGLSSWHFHDALDIWGQGTMVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRDSSGNHLWVFGGGTKLTVLGSHHHHHHHH

SEQ ID NO: 225 - protein, 490 aa, Artificial Sequence
  Description of Artificial Sequence: Synthetic polypeptide
MALPVTALLLPLALLLHAARPEVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKGLSSWHFHDALDIWGQGTMVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRDSSGNHLWVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 226 - DNA, 1470 bp, Artificial Sequence
  Description of Artificial Sequence: Synthetic polynucleotide
atggccctccctgtcaccgccctgctgcttccgctggctcttctgctccacgccgctcggcccgaagtgcagttggtggaatcaggaggaggacttgtgcaacctggaagatctctcagactctcgtgtgcggcctccggtttcaccttcgacgactacgccatgcattgggtcagacaggccccgggaaagggcctggagtgggtgtcaggcatctcatggaacagcggctccattggctacgccgactcggtcaagggaaggttcactatctcccgggacaacgccaagaactccctgtacctccaaatgaacagcctgcgcgccgaggatactgccctgtactactgcgccaaggggctgtccagctggcactttcacgacgcacttgatatctggggacagggtaccatggtcaccgtgtcctccggtggcggaggctcagggggaggaggaagcgggggcggtggttcctcctccgaactgacccaggacccggccgtgtccgtggcgctgggacaaaccgtgcgcattacttgccagggcgacagcttgcggtcgtactacgcctcgtggtaccagcagaagcccggccaggctcccgtgctggtcatctatggcaaaaacaaccgcccgagcggaattccagaccggttctccgggagctcgtccgggaacaccgcttcgctcaccatcacgggggcccaggcggaggacgaagcagattactactgcaactcgcgggattccagcggcaatcacctctgggtgttcgggggcggaaccaagctgactgtgctgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 227 - protein, 245 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDKGGGYYDFWSGSDYWGQGTLVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRDSSGWVFGGGTKLTVL

SEQ ID NO: 228 - DNA, 828 bp, Artificial Sequence
  Description of Artificial Sequence: Synthetic polynucleotide
atggccctccctgtcaccgccctgctgcttccgctggctcttctgctccacgccgctcggcccgaagtgcaacttgtggaatctggtggaggacttgtgcaacctggaagatcactgagactgtcatgtgcagcctcggggtttaccttcgacgactacgccatgcactgggtgcgccaggctccggggaagggcctcgaatgggtgtcgggcatcagctggaactccggttccattggctatgcggactccgtgaaaggacgcttcacaatttcccgggataacgccaagaacagcctgtacttgcagatgaactccctgcgggccgaggataccgccctgtactactgcgctaaggacaagggcggtggatactacgacttctggagcggaagcgactactggggacagggaactctggtcaccgtgtcctccggcggagggggctccggcggcggtggtagcgggggtggagggtcgtcgtcggagctgacccaggaccccgcagtgtccgtcgccctggggcagactgtgcggatcacttgccaaggagacagcctgcggtcctactacgcgtcctggtatcagcagaagccggggcaggccccagtcctcgtcatctacggaaagaacaataggcccagcggaatccctgaccgcttctcgggctcatcctccggcaacaccgcctccctgaccatcacgggcgcgcaggccgaggacgaagccgattactactgcaactcacgggattccagcggatgggtgttcggaggaggaaccaagctcactgtgctcggatcgcaccaccatcaccatcatcatcac

SEQ ID NO: 229 - protein, 276 aa, Artificial Sequence
  Description of Artificial Sequence: Synthetic polypeptide
MALPVTALLLPLALLLHAARPEVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDKGGGYYDFWSGSDYWGQGTLVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRDSSGWVFGGGTKLTVLGSHHHHHHHH

SEQ ID NO: 230 - protein, 489 aa, Artificial Sequence
  Description of Artificial Sequence: Synthetic polypeptide
MALPVTALLLPLALLLHAARPEVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDKGGGYYDFWSGSDYWGQGTLVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRDSSGWVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 231 - DNA, 1467 bp, Artificial Sequence
  Description of Artificial Sequence: Synthetic polynucleotide
atggccctccctgtcaccgccctgctgcttccgctggctcttctgctccacgccgctcggcccgaagtgcaacttgtggaatctggtggaggacttgtgcaacctggaagatcactgagactgtcatgtgcagcctcggggtttaccttcgacgactacgccatgcactgggtgcgccaggctccggggaagggcctcgaatgggtgtcgggcatcagctggaactccggttccattggctatgcggactccgtgaaaggacgcttcacaatttcccgggataacgccaagaacagcctgtacttgcagatgaactccctgcgggccgaggataccgccctgtactactgcgctaaggacaagggcggtggatactacgacttctggagcggaagcgactactggggacagggaactctggtcaccgtgtcctccggcggagggggctccggcggcggtggtagcgggggtggagggtcgtcgtcggagctgacccaggaccccgcagtgtccgtcgccctggggcagactgtgcggatcacttgccaaggagacagcctgcggtcctactacgcgtcctggtatcagcagaagccggggcaggccccagtcctcgtcatctacggaaagaacaataggcccagcggaatccctgaccgcttctcgggctcatcctccggcaacaccgcctccctgaccatcacgggcgcgcaggccgaggacgaagccgattactactgcaactcacgggattccagcggatgggtgttcggaggaggaaccaagctcactgtgctcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 232 - protein, 247 aa, Artificial Sequence
  Description of Artificial Sequence: Synthetic polypeptide
EVQLQQSGPGLVKPSLTLSLTCAISGDSVSSNSATWTWIRQSPSRGLEWLGRTYYRSTWYNDYAVSVKSRITINPDTSKNQFSLQLNSVTPEDTAVYYCAREGSGSYYAYWGQGTLVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLYVFGTGTKVTVL

SEQ ID NO: 233 - DNA, 741 bp, Artificial Sequence
  Description of Artificial Sequence: Synthetic polynucleotide
gaagtgcaactccaacaatcaggtccaggactcgtcaaaccctcgcttactctgtcgctgacttgtgctatctcgggagactccgtgagctccaacagcgccacctggacttggattagacagtccccgtcacggggcctcgaatggctgggaaggacctactaccggagcacctggtacaacgactatgctgtgtccgtgaagtcccgcatcaccatcaaccccgatacctccaagaaccagttcagcttgcaactgaactccgtgacccctgaggatacggccgtctattactgcgcccgcgaggggtccggttcctactacgcctactggggacagggtactctggtcaccgtgtcgagcggagggggggggtccggcggaggaggatctggtggcggaggctcccagtccgcgctgacccagcctgcgtccgtgtccggctcaccgggccagtctatcaccattagctgcaccggcactagctcagacgtgggagggtacaactacgtgtcgtggtaccagcagcaccctggaaaggccccgaagctgatgatctacgacgtgtccaaccggcccagcggggtgtcgaatcgcttctccggctcaaagtccggcaacacagccagcctgaccattagcggactgcaggccgaggatgaagcagactactactgctcgtcctacacctcctcctcgactctctacgtgtttggcaccggaactaaggtcaccgtgctg

SEQ ID NO: 234 - DNA, 834 bp, Artificial Sequence
  Description of Artificial Sequence: Synthetic polynucleotide
atggccctccctgtcaccgccctgctgcttccgctggctcttctgctccacgccgctcggcccgaagtgcaactccaacaatcaggtccaggactcgtcaaaccctcgcttactctgtcgctgacttgtgctatctcgggagactccgtgagctccaacagcgccacctggacttggattagacagtccccgtcacggggcctcgaatggctgggaaggacctactaccggagcacctggtacaacgactatgctgtgtccgtgaagtcccgcatcaccatcaaccccgatacctccaagaaccagttcagcttgcaactgaactccgtgacccctgaggatacggccgtctattactgcgcccgcgaggggtccggttcctactacgcctactggggacagggtactctggtcaccgtgtcgagcggagggggggggtccggcggaggaggatctggtggcggaggctcccagtccgcgctgacccagcctgcgtccgtgtccggctcaccgggccagtctatcaccattagctgcaccggcactagctcagacgtgggagggtacaactacgtgtcgtggtaccagcagcaccctggaaaggccccgaagctgatgatctacgacgtgtccaaccggcccagcggggtgtcgaatcgcttctccggctcaaagtccggcaacacagccagcctgaccattagcggactgcaggccgaggatgaagcagactactactgctcgtcctacacctcctcctcgactctctacgtgtttggcaccggaactaaggtcaccgtgctgggatcgcaccaccatcaccatcatcatcac

SEQ ID NO: 235 - protein, 279 aa, Artificial Sequence
  Description of Artificial Sequence: Synthetic polypeptide
MALPVTALLLPLALLLHAARPEVQLQQSGPGLVKPSLTLSLTCAISGDSVSSNSATWTWIRQSPSRGLEWLGRTYYRSTWYNDYAVSVKSRITINPDTSKNQFSLQLNSVTPEDTAVYYCAREGSGSYYAYWGQGTLVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLYVFGTGTKVTVLGSHHHHHHHHH

SEQ ID NO: 236 - protein, 491 aa, Artificial Sequence
  Description of Artificial Sequence: Synthetic polypeptide
MALPVTALLLPLALLLHAARPEVQLQQSGPGLVKPSLTLSLTCAISGDSVSSNSATWTWIRQSPSRGLEWLGRTYYRSTWYNDYAVSVKSRITINPDTSKNQFSLQLNSVTPEDTAVYYCAREGSGSYYAYWGQGTLVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLYVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 237 - DNA, 1473 bp, Artificial Sequence
  Description of Artificial Sequence: Synthetic polynucleotide
atggccctccctgtcaccgccctgctgcttccgctggctcttctgctccacgccgctcggcccgaagtgcaactccaacaatcaggtccaggactcgtcaaaccctcgcttactctgtcgctgacttgtgctatctcgggagactccgtgagctccaacagcgccacctggacttggattagacagtccccgtcacggggcctcgaatggctgggaaggacctactaccggagcacctggtacaacgactatgctgtgtccgtgaagtcccgcatcaccatcaaccccgatacctccaagaaccagttcagcttgcaactgaactccgtgacccctgaggatacggccgtctattactgcgcccgcgaggggtccggttcctactacgcctactggggacagggtactctggtcaccgtgtcgagcggagggggggggtccggcggaggaggatctggtggcggaggctcccagtccgcgctgacccagcctgcgtccgtgtccggctcaccgggccagtctatcaccattagctgcaccggcactagctcagacgtgggagggtacaactacgtgtcgtggtaccagcagcaccctggaaaggccccgaagctgatgatctacgacgtgtccaaccggcccagcggggtgtcgaatcgcttctccggctcaaagtccggcaacacagccagcctgaccattagcggactgcaggccgaggatgaagcagactactactgctcgtcctacacctcctcctcgactctctacgtgtttggcaccggaactaaggtcaccgtgctgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 238 - protein, 247 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDYWGYYGSGTLDYWGQGTLVTVSSGGGGSGGGGSGGGGSQSALTQPGSVSGSPGQSITISCTGTSSDVGGYNYVSWYQQHPGKAPKLIIYDVSSRPSGVSNRFSGSQSGNTASLTISGLQAEDEADYSCSSYAGSNTLVFGTGTKVTVL

SEQ ID NO: 239 - DNA, 741 bp, Artificial Sequence
  Description of Artificial Sequence: Synthetic polynucleotide
caagtccaactcgtccagtccggtgcagaagtcaagaagccaggagcgtccgtgaaagtgtcctgcaaagcctcgggctacaccttcaccggatactacatgcactgggtgcgccaggctcccggacaaggattggagtggatgggttggatcaacccgaactccggcggaaccaactacgcccagaagttccagggacgcgtgactatgactcgggacacgtccatcagcactgcctacatggaactgagccggcttagatcagacgacaccgccgtgtactactgcgcccgcgattactggggctactacggaagcggaaccctcgactactggggacagggaactctcgtgactgtgtcgagcggtggaggcggctccggcggagggggttccggtggtggaggctcccagtccgcgctgacccagcctgggtcggtgtccggctcacctggccaatccatcaccatttcctgcaccggcacttcctccgacgtgggagggtacaactacgtgtcgtggtaccagcagcatccgggaaaggcccccaagctgatcatctacgatgtgtcgtcccggccgagcggagtgtcaaacaggtttagcgggagccagtccgggaatactgcctcgctgacaattagcgggctgcaggctgaggacgaggccgattattcgtgttcctcatatgcgggctctaacaccctggtgttcggcaccgggaccaaggtcaccgtgctg

SEQ ID NO: 240 - DNA, 834 bp, Artificial Sequence
  Description of Artificial Sequence: Synthetic polynucleotide
atggccctccctgtcaccgccctgctgcttccgctggctcttctgctccacgccgctcggccccaagtccaactcgtccagtccggtgcagaagtcaagaagccaggagcgtccgtgaaagtgtcctgcaaagcctcgggctacaccttcaccggatactacatgcactgggtgcgccaggctcccggacaaggattggagtggatgggttggatcaacccgaactccggcggaaccaactacgcccagaagttccagggacgcgtgactatgactcgggacacgtccatcagcactgcctacatggaactgagccggcttagatcagacgacaccgccgtgtactactgcgcccgcgattactggggctactacggaagcggaaccctcgactactggggacagggaactctcgtgactgtgtcgagcggtggaggcggctccggcggagggggttccggtggtggaggctcccagtccgcgctgacccagcctgggtcggtgtccggctcacctggccaatccatcaccatttcctgcaccggcacttcctccgacgtgggagggtacaactacgtgtcgtggtaccagcagcatccgggaaaggcccccaagctgatcatctacgatgtgtcgtcccggccgagcggagtgtcaaacaggtttagcgggagccagtccgggaatactgcctcgctgacaattagcgggctgcaggctgaggacgaggccgattattcgtgttcctcatatgcgggctctaacaccctggtgttcggcaccgggaccaaggtcaccgtgctgggatcgcaccaccatcaccatcatcatcac

SEQ ID NO: 241 - protein, 279 aa, Artificial Sequence
  Description of Artificial Sequence: Synthetic polypeptide
MALPVTALLLPLALLLHAARPQVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDYWGYYGSGTLDYWGQGTLVTVSSGGGGSGGGGSGGGGSQSALTQPGSVSGSPGQSITISCTGTSSDVGGYNYVSWYQQHPGKAPKLIIYDVSSRPSGVSNRFSGSQSGNTASLTISGLQAEDEADYSCSSYAGSNTLVFGTGTKVTVLGSHHHHHHHHH

SEQ ID NO: 242 - protein, 491 aa, Artificial Sequence
  Description of Artificial Sequence: Synthetic polypeptide
MALPVTALLLPLALLLHAARPQVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDYWGYYGSGTLDYWGQGTLVTVSSGGGGSGGGGSGGGGSQSALTQPGSVSGSPGQSITISCTGTSSDVGGYNYVSWYQQHPGKAPKLIIYDVSSRPSGVSNRFSGSQSGNTASLTISGLQAEDEADYSCSSYAGSNTLVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 243 - DNA, 1473 bp, Artificial Sequence
  Description of Artificial Sequence: Synthetic polynucleotide
atggccctccctgtcaccgccctgctgcttccgctggctcttctgctccacgccgctcggccccaagtccaactcgtccagtccggtgcagaagtcaagaagccaggagcgtccgtgaaagtgtcctgcaaagcctcgggctacaccttcaccggatactacatgcactgggtgcgccaggctcccggacaaggattggagtggatgggttggatcaacccgaactccggcggaaccaactacgcccagaagttccagggacgcgtgactatgactcgggacacgtccatcagcactgcctacatggaactgagccggcttagatcagacgacaccgccgtgtactactgcgcccgcgattactggggctactacggaagcggaaccctcgactactggggacagggaactctcgtgactgtgtcgagcggtggaggcggctccggcggagggggttccggtggtggaggctcccagtccgcgctgacccagcctgggtcggtgtccggctcacctggccaatccatcaccatttcctgcaccggcacttcctccgacgtgggagggtacaactacgtgtcgtggtaccagcagcatccgggaaaggcccccaagctgatcatctacgatgtgtcgtcccggccgagcggagtgtcaaacaggtttagcgggagccagtccgggaatactgcctcgctgacaattagcgggctgcaggctgaggacgaggccgattattcgtgttcctcatatgcgggctctaacaccctggtgttcggcaccgggaccaaggtcaccgtgctgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 244 - protein, 254 aa, Artificial Sequence
  Description of Artificial Sequence: Synthetic polypeptide
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARAGLALYSNYVPYYYYGMDVWGQGTTVTVSSGGGGSGGGGSGGGGSNFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSNPWVFGGGTKLTVL

SEQ ID NO: 245 - DNA, 762 bp, Artificial Sequence
  Description of Artificial Sequence: Synthetic polynucleotide
caagtccaactggtgcagtcgggagccgaagtcaagaagccgggggcctccgtcaaagtgtcctgcaaagccagcggctacactttcacctcctatgggatctcatgggtcagacaggctcccggccaaggactggaatggatgggttggatctccgcctacaacggcaacactaactacgcccagaagctgcaggggagagtgaccatgacaactgacacctcgacctcaaccgcgtacatggaactgcgcagccttaggtccgacgatacggcggtgtactattgtgcacgggccggcttggccctctactcgaactacgtgccctactactactacggaatggacgtctggggacagggaaccactgtgaccgtgtcctccgggggtggaggctcaggcggaggaggaagcggcgggggtggaagcaactttatgctgacccagcctcactcggtgtcggagagccctggaaagactgtgaccatctcctgcactcggagctcgggctccattgcgtcaaactacgtgcagtggtaccagcagcgccccggttcctcgccaaccaccgtgatctacgaggacaaccaacgcccgtccggggtgcctgaccggttctccggctccatcgattcctcttccaactccgcttccctgaccattagcggcctcaagaccgaggatgaagccgactactactgccagtcctacgactcaagcaatccgtgggtgttcggtggaggaactaagctgaccgtgctc

SEQ ID NO: 246 - DNA, 855 bp, Artificial Sequence
  Description of Artificial Sequence: Synthetic polynucleotide
atggccctccctgtcaccgccctgctgcttccgctggctcttctgctccacgccgctcggccccaagtccaactggtgcagtcgggagccgaagtcaagaagccgggggcctccgtcaaagtgtcctgcaaagccagcggctacactttcacctcctatgggatctcatgggtcagacaggctcccggccaaggactggaatggatgggttggatctccgcctacaacggcaacactaactacgcccagaagctgcaggggagagtgaccatgacaactgacacctcgacctcaaccgcgtacatggaactgcgcagccttaggtccgacgatacggcggtgtactattgtgcacgggccggcttggccctctactcgaactacgtgccctactactactacggaatggacgtctggggacagggaaccactgtgaccgtgtcctccgggggtggaggctcaggcggaggaggaagcggcgggggtggaagcaactttatgctgacccagcctcactcggtgtcggagagccctggaaagactgtgaccatctcctgcactcggagctcgggctccattgcgtcaaactacgtgcagtggtaccagcagcgccccggttcctcgccaaccaccgtgatctacgaggacaaccaacgcccgtccggggtgcctgaccggttctccggctccatcgattcctcttccaactccgcttccctgaccattagcggcctcaagaccgaggatgaagccgactactactgccagtcctacgactcaagcaatccgtgggtgttcggtggaggaactaagctgaccgtgctcggatcgcaccaccatcaccatcatcatcac

SEQ ID NO: 247 - protein, 285 aa, Artificial Sequence
  Description of Artificial Sequence: Synthetic polypeptide
MALPVTALLLPLALLLHAARPQVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARAGLALYSNYVPYYYYGMDVWGQGTTVTVSSGGGGSGGGGSGGGGSNFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSNPWVFGGGTKLTVLGSHHHHHHHH

SEQ ID NO: 248 - protein, 498 aa, Artificial Sequence
  Description of Artificial Sequence: Synthetic polypeptide
MALPVTALLLPLALLLHAARPQVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARAGLALYSNYVPYYYYGMDVWGQGTTVTVSSGGGGSGGGGSGGGGSNFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSNPWVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 249 - DNA, 1494 bp, Artificial Sequence
  Description of Artificial Sequence: Synthetic polynucleotide
atggccctccctgtcaccgccctgctgcttccgctggctcttctgctccacgccgctcggccccaagtccaactggtgcagtcgggagccgaagtcaagaagccgggggcctccgtcaaagtgtcctgcaaagccagcggctacactttcacctcctatgggatctcatgggtcagacaggctcccggccaaggactggaatggatgggttggatctccgcctacaacggcaacactaactacgcccagaagctgcaggggagagtgaccatgacaactgacacctcgacctcaaccgcgtacatggaactgcgcagccttaggtccgacgatacggcggtgtactattgtgcacgggccggcttggccctctactcgaactacgtgccctactactactacggaatggacgtctggggacagggaaccactgtgaccgtgtcctccgggggtggaggctcaggcggaggaggaagcggcgggggtggaagcaactttatgctgacccagcctcactcggtgtcggagagccctggaaagactgtgaccatctcctgcactcggagctcgggctccattgcgtcaaactacgtgcagtggtaccagcagcgccccggttcctcgccaaccaccgtgatctacgaggacaaccaacgcccgtccggggtgcctgaccggttctccggctccatcgattcctcttccaactccgcttccctgaccattagcggcctcaagaccgaggatgaagccgactactactgccagtcctacgactcaagcaatccgtgggtgttcggtggaggaactaagctgaccgtgctcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 250 - protein, 241 aa, Artificial Sequence
  Description of Artificial Sequence: Synthetic polypeptide
EVQLVESGGGLVKPGGSLRLSCVASGFTFSNAWMNWVRQAPGKGLEWVGRIKSKTDGGTADYAAPVKGRFTISRDDSKNTMYLQMNSLKTEDTGVYYCITGATDVWGQGTTVTVSSGGGGSGGGGSGGGGSSYVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGPVFGGGTKLTVL

SEQ ID NO: 251 - DNA, 723 bp, Artificial Sequence
  Description of Artificial Sequence: Synthetic polynucleotide
gaagtgcagctcgtggaatcgggcggtggactggtcaagccaggaggttccctgcggctgtcctgcgtggcctccggtttcacattctccaacgcgtggatgaattgggtgcgccaagcccctggaaagggacttgaatgggtcggacggatcaagagcaaaaccgacggaggaactgccgattacgccgcacccgtgaagggcagattcaccatttcgcgggatgactcgaagaacaccatgtacctccagatgaactcgctcaagaccgaggataccggcgtctactactgcatcaccggcgctactgacgtctggggacagggaactaccgtgactgtgtcctccggcggaggcggaagcggaggagggggcagcgggggcgggggatcatcctacgtgctcactcagccgccttcagcctccggtaccccgggccagcgcgtgaccatttcatgctcgggctcctcctcaaacatcgggagcaactacgtgtactggtaccagcagctgcccggtactgcccccaagctgctgatctaccggaacaaccaacgcccgagcggagtgccggacagattctccgggtccaagtctgggacctccgctagcctggcgatctccggtctgaggagcgaggacgaggcagactactattgtgcggcctgggacgattccctgtcggggcctgtgtttggaggcggcacgaagttgaccgtgctg

SEQ ID NO: 252 - DNA, 816 bp, Artificial Sequence
  Description of Artificial Sequence: Synthetic polynucleotide
atggccctccctgtcaccgccctgctgcttccgctggctcttctgctccacgccgctcggcccgaagtgcagctcgtggaatcgggcggtggactggtcaagccaggaggttccctgcggctgtcctgcgtggcctccggtttcacattctccaacgcgtggatgaattgggtgcgccaagcccctggaaagggacttgaatgggtcggacggatcaagagcaaaaccgacggaggaactgccgattacgccgcacccgtgaagggcagattcaccatttcgcgggatgactcgaagaacaccatgtacctccagatgaactcgctcaagaccgaggataccggcgtctactactgcatcaccggcgctactgacgtctggggacagggaactaccgtgactgtgtcctccggcggaggcggaagcggaggagggggcagcgggggcgggggatcatcctacgtgctcactcagccgccttcagcctccggtaccccgggccagcgcgtgaccatttcatgctcgggctcctcctcaaacatcgggagcaactacgtgtactggtaccagcagctgcccggtactgcccccaagctgctgatctaccggaacaaccaacgcccgagcggagtgccggacagattctccgggtccaagtctgggacctccgctagcctggcgatctccggtctgaggagcgaggacgaggcagactactattgtgcggcctgggacgattccctgtcggggcctgtgtttggaggcggcacgaagttgaccgtgctgggatcgcaccaccatcaccatcatcatcac

SEQ ID NO: 253 - protein, 272 aa, Artificial Sequence
  Description of Artificial Sequence: Synthetic polypeptide
MALPVTALLLPLALLLHAARPEVQLVESGGGLVKPGGSLRLSCVASGFTFSNAWMNWVRQAPGKGLEWVGRIKSKTDGGTADYAAPVKGRFTISRDDSKNTMYLQMNSLKTEDTGVYYCITGATDVWGQGTTVTVSSGGGGSGGGGSGGGGSSYVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGPVFGGGTKLTVLGSHHHHHHHH

SEQ ID NO: 254 - protein, 485 aa, Artificial Sequence
  Description of Artificial Sequence: Synthetic polypeptide
MALPVTALLLPLALLLHAARPEVQLVESGGGLVKPGGSLRLSCVASGFTFSNAWMNWVRQAPGKGLEWVGRIKSKTDGGTADYAAPVKGRFTISRDDSKNTMYLQMNSLKTEDTGVYYCITGATDVWGQGTTVTVSSGGGGSGGGGSGGGGSSYVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGPVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 255 - DNA, 1455 bp, Artificial Sequence
  Description of Artificial Sequence: Synthetic polynucleotide
atggccctccctgtcaccgccctgctgcttccgctggctcttctgctccacgccgctcggcccgaagtgcagctcgtggaatcgggcggtggactggtcaagccaggaggttccctgcggctgtcctgcgtggcctccggtttcacattctccaacgcgtggatgaattgggtgcgccaagcccctggaaagggacttgaatgggtcggacggatcaagagcaaaaccgacggaggaactgccgattacgccgcacccgtgaagggcagattcaccatttcgcgggatgactcgaagaacaccatgtacctccagatgaactcgctcaagaccgaggataccggcgtctactactgcatcaccggcgctactgacgtctggggacagggaactaccgtgactgtgtcctccggcggaggcggaagcggaggagggggcagcgggggcgggggatcatcctacgtgctcactcagccgccttcagcctccggtaccccgggccagcgcgtgaccatttcatgctcgggctcctcctcaaacatcgggagcaactacgtgtactggtaccagcagctgcccggtactgcccccaagctgctgatctaccggaacaaccaacgcccgagcggagtgccggacagattctccgggtccaagtctgggacctccgctagcctggcgatctccggtctgaggagcgaggacgaggcagactactattgtgcggcctgggacgattccctgtcggggcctgtgtttggaggcggcacgaagttgaccgtgctgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 256 - protein, 254 aa, Artificial Sequence
  Description of Artificial Sequence: Synthetic polypeptide
EVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLVYVFGTGTKVTVL

SEQ ID NO: 257 - DNA, 762 bp, Artificial Sequence
  Description of Artificial Sequence: Synthetic polynucleotide
gaagtgcagcttcagcagtctggtcccgggcttgtcaaaccatcgcagaccctgtccctgacttgcgcgatcagcggcgatagcgtgctgtcaaactcggacacctggaactggatcaggcagtccccttcccgcggactggaatggttgggccggacgtaccatcgctccacttggtacgacgactatgccagctccgtgagaggccgggtgtcgatcaacgtggatacttcaaagaaccagtactccctccaactcaatgctgtgaccccggaggacaccggagtgtactactgtgcccgggatagactgcaggacggaaactcatggagcgacgccttcgacgtgtggggacagggcaccatggtcaccgtgtccagcggtggaggaggctccggcggtggaggttcggggggaggagggagccaatcggctctgacccaaccggcctcagtcagcggttcgcccggacagtccattactattagctgcaccggaacctccagcgacgtgggcggctacaactatgtgtcgtggtaccagcagcacccggggaaggcccctaagctgatgatctacgacgtgtccaatcggccctccggggtgtccaaccgcttctccggctcgaagtccggcaacactgcatcactgacaatcagcggactgcaagccgaggacgaagcggattactactgctcctcctacacctcctcctccactctcgtctacgtgtttggaaccgggaccaaggtcaccgtgctg

SEQ ID NO: 258 - DNA, 855 bp, Artificial Sequence
  Description of Artificial Sequence: Synthetic polynucleotide
atggccctccctgtcaccgccctgctgcttccgctggctcttctgctccacgccgctcggcccgaagtgcagcttcagcagtctggtcccgggcttgtcaaaccatcgcagaccctgtccctgacttgcgcgatcagcggcgatagcgtgctgtcaaactcggacacctggaactggatcaggcagtccccttcccgcggactggaatggttgggccggacgtaccatcgctccacttggtacgacgactatgccagctccgtgagaggccgggtgtcgatcaacgtggatacttcaaagaaccagtactccctccaactcaatgctgtgaccccggaggacaccggagtgtactactgtgcccgggatagactgcaggacggaaactcatggagcgacgccttcgacgtgtggggacagggcaccatggtcaccgtgtccagcggtggaggaggctccggcggtggaggttcggggggaggagggagccaatcggctctgacccaaccggcctcagtcagcggttcgcccggacagtccattactattagctgcaccggaacctccagcgacgtgggcggctacaactatgtgtcgtggtaccagcagcacccggggaaggcccctaagctgatgatctacgacgtgtccaatcggccctccggggtgtccaaccgcttctccggctcgaagtccggcaacactgcatcactgacaatcagcggactgcaagccgaggacgaagcggattactactgctcctcctacacctcctcctccactctcgtctacgtgtttggaaccgggaccaaggtcaccgtgctgggatcgcaccaccatcaccatcatcatcac

SEQ ID NO: 259 - protein, 285 aa, Artificial Sequence
  Description of Artificial Sequence: Synthetic polypeptide
MALPVTALLLPLALLLHAARPEVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLVYVFGTGTKVTVLGSHHHHHHHH

SEQ ID NO: 260 - protein, 498 aa, Artificial Sequence
  Description of Artificial Sequence: Synthetic polypeptide
MALPVTALLLPLALLLHAARPEVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLVYVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 261 - DNA, 1494 bp, Artificial Sequence
  Description of Artificial Sequence: Synthetic polynucleotide
atggccctccctgtcaccgccctgctgcttccgctggctcttctgctccacgccgctcggcccgaagtgcagcttcagcagtctggtcccgggcttgtcaaaccatcgcagaccctgtccctgacttgcgcgatcagcggcgatagcgtgctgtcaaactcggacacctggaactggatcaggcagtccccttcccgcggactggaatggttgggccggacgtaccatcgctccacttggtacgacgactatgccagctccgtgagaggccgggtgtcgatcaacgtggatacttcaaagaaccagtactccctccaactcaatgctgtgaccccggaggacaccggagtgtactactgtgcccgggatagactgcaggacggaaactcatggagcgacgccttcgacgtgtggggacagggcaccatggtcaccgtgtccagcggtggaggaggctccggcggtggaggttcggggggaggagggagccaatcggctctgacccaaccggcctcagtcagcggttcgcccggacagtccattactattagctgcaccggaacctccagcgacgtgggcggctacaactatgtgtcgtggtaccagcagcacccggggaaggcccctaagctgatgatctacgacgtgtccaatcggccctccggggtgtccaaccgcttctccggctcgaagtccggcaacactgcatcactgacaatcagcggactgcaagccgaggacgaagcggattactactgctcctcctacacctcctcctccactctcgtctacgtgtttggaaccgggaccaaggtcaccgtgctgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 262 - protein, 249 aa, Artificial Sequence
  Description of Artificial Sequence: Synthetic polypeptide
EVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREESSSGWYEGNWFDPWGQGTLVTVSSGGGGSGGGGSGGGGSSSELTQDPAVSVALGQTVRITCQGDSLRSYYASWYQQKPGQAPVLVIYGKNHRPSGIPDRFSGSSSGDTDSLTITGAQAEDEADYYCHSRDSSGNHLFGGGTKLTVL

SEQ ID NO: 263 - DNA, 747 bp, Artificial Sequence
  Description of Artificial Sequence: Synthetic polynucleotide
gaagtgcaacttcagcagtccggtcctggcttggtcaagccgtcacagaccctgtcgctgacttgtgctattagcggggactctgtgtcctcaaactccgccgcatggaactggattagacagtcgccctcccggggactggagtggctgggccgcacctactaccggtccaagtggtacaatgactacgccgtgtccgtgaagtcccgcattactatcaaccccgacacttcgaagaaccagttttcgctgcaactcaactccgtcacccctgaggataccgccgtgtactattgcgcccgggaagaatcctccagcggttggtacgaaggaaactggttcgacccatggggccagggcaccctggtcactgtgtcctcgggaggagggggcagcggtggcggaggaagcggaggaggaggctccagctccgagctcacccaggacccggcggtgtcagtggccctgggccaaacggtccgcatcacatgccagggggattccctgaggtcatactacgcgagctggtatcagcagaaacccggacaagcccctgtgctcgtgatctacgggaagaaccacaggccgagcggaatcccggatagattctccgggtcctcatcgggagacactgacagcctcaccatcaccggcgcgcaggccgaggacgaagctgattactactgccattcccgggactcgagcgggaaccaccttttcggtggcggaaccaagctgaccgtgctg

SEQ ID NO: 264 - DNA, 840 bp, Artificial Sequence
  Description of Artificial Sequence: Synthetic polynucleotide
atggccctccctgtcaccgccctgctgcttccgctggctcttctgctccacgccgctcggcccgaagtgcaacttcagcagtccggtcctggcttggtcaagccgtcacagaccctgtcgctgacttgtgctattagcggggactctgtgtcctcaaactccgccgcatggaactggattagacagtcgccctcccggggactggagtggctgggccgcacctactaccggtccaagtggtacaatgactacgccgtgtccgtgaagtcccgcattactatcaaccccgacacttcgaagaaccagttttcgctgcaactcaactccgtcacccctgaggataccgccgtgtactattgcgcccgggaagaatcctccagcggttggtacgaaggaaactggttcgacccatggggccagggcaccctggtcactgtgtcctcgggaggagggggcagcggtggcggaggaagcggaggaggaggctccagctccgagctcacccaggacccggcggtgtcagtggccctgggccaaacggtccgcatcacatgccagggggattccctgaggtcatactacgcgagctggtatcagcagaaacccggacaagcccctgtgctcgtgatctacgggaagaaccacaggccgagcggaatcccggatagattctccgggtcctcatcgggagacactgacagcctcaccatcaccggcgcgcaggccgaggacgaagctgattactactgccattcccgggactcgagcgggaaccaccttttcggtggcggaaccaagctgaccgtgctgggatcgcaccaccatcaccatcatcatcac

SEQ ID NO: 265 - protein, 280 aa, Artificial Sequence
  Description of Artificial Sequence: Synthetic polypeptide
MALPVTALLLPLALLLHAARPEVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREESSSGWYEGNWFDPWGQGTLVTVSSGGGGSGGGGSGGGGSSSELTQDPAVSVALGQTVRITCQGDSLRSYYASWYQQKPGQAPVLVIYGKNHRPSGIPDRFSGSSSGDTDSLTITGAQAEDEADYYCHSRDSSGNHLFGGGTKLTVLGSHHHHHHHH

SEQ ID NO: 266 - protein, 493 aa, Artificial Sequence
  Description of Artificial Sequence: Synthetic polypeptide
MALPVTALLLPLALLLHAARPEVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREESSSGWYEGNWFDPWGQGTLVTVSSGGGGSGGGGSGGGGSSSELTQDPAVSVALGQTVRITCQGDSLRSYYASWYQQKPGQAPVLVIYGKNHRPSGIPDRFSGSSSGDTDSLTITGAQAEDEADYYCHSRDSSGNHLFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 267 - DNA, 1479 bp, Artificial Sequence
  Description of Artificial Sequence: Synthetic polynucleotide
atggccctccctgtcaccgccctgctgcttccgctggctcttctgctccacgccgctcggcccgaagtgcaacttcagcagtccggtcctggcttggtcaagccgtcacagaccctgtcgctgacttgtgctattagcggggactctgtgtcctcaaactccgccgcatggaactggattagacagtcgccctcccggggactggagtggctgggccgcacctactaccggtccaagtggtacaatgactacgccgtgtccgtgaagtcccgcattactatcaaccccgacacttcgaagaaccagttttcgctgcaactcaactccgtcacccctgaggataccgccgtgtactattgcgcccgggaagaatcctccagcggttggtacgaaggaaactggttcgacccatggggccagggcaccctggtcactgtgtcctcgggaggagggggcagcggtggcggaggaagcggaggaggaggctccagctccgagctcacccaggacccggcggtgtcagtggccctgggccaaacggtccgcatcacatgccagggggattccctgaggtcatactacgcgagctggtatcagcagaaacccggacaagcccctgtgctcgtgatctacgggaagaaccacaggccgagcggaatcccggatagattctccgggtcctcatcgggagacactgacagcctcaccatcaccggcgcgcaggccgaggacgaagctgattactactgccattcccgggactcgagcgggaaccaccttttcggtggcggaaccaagctgaccgtgctgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 268 - protein, 253 aa, Artificial Sequence
  Description of Artificial Sequence: Synthetic polypeptide
EVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSGGGGSGGGGSGGGGSQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVL

SEQ ID NO: 269 - DNA, 759 bp, Artificial Sequence
  Description of Artificial Sequence: Synthetic polynucleotide
gaagtgcagctgcagcagagcggaccgggcctggtcaaaccctcccaaaccctgtccctcacttgcgcgatctccggggactccgtgctctcgaactccgacacctggaactggattcggcagagcccatcgaggggcctggaatggctgggaagaacctaccaccggtccacttggtacgatgactacgcgagctcagtgcgcggacgcgtgtcgattaacgtggacacctccaagaaccagtacagcttgcaactgaacgccgtgacccctgaggacaccggagtgtactattgcgcccgggatagacttcaggacggaaacagctggtccgacgcctttgacgtctggggacagggcaccatggtcactgtgtcctcgggtggcggggggtccggtggaggaggttcaggcggaggcggctcacagtcagcactgacgcagccggcttccgcttccgggagccctggacagagcgtgaccatctcgtgtaccgggacttccagcgatgtcggcgggtacaactacgtgtcttggtaccaacagcatccgggaaaggcccccaagctcatgatctacgacgtgtcaaaccggcccagcggagtgtccaatcgcttctccggctccaagtcgggcaatactgcctcgctgactatcagcggtctgcaagccgaagatgaggccgactattactgctcctcctacacctcgtcctccacactctacgtgttcggaaccggtactcagctgaccgtgctt

SEQ ID NO: 270 - DNA, 852 bp, Artificial Sequence
  Description of Artificial Sequence: Synthetic polynucleotide
atggccctccctgtcaccgccctgctgcttccgctggctcttctgctccacgccgctcggcccgaagtgcagctgcagcagagcggaccgggcctggtcaaaccctcccaaaccctgtccctcacttgcgcgatctccggggactccgtgctctcgaactccgacacctggaactggattcggcagagcccatcgaggggcctggaatggctgggaagaacctaccaccggtccacttggtacgatgactacgcgagctcagtgcgcggacgcgtgtcgattaacgtggacacctccaagaaccagtacagcttgcaactgaacgccgtgacccctgaggacaccggagtgtactattgcgcccgggatagacttcaggacggaaacagctggtccgacgcctttgacgtctggggacagggcaccatggtcactgtgtcctcgggtggcggggggtccggtggaggaggttcaggcggaggcggctcacagtcagcactgacgcagccggcttccgcttccgggagccctggacagagcgtgaccatctcgtgtaccgggacttccagcgatgtcggcgggtacaactacgtgtcttggtaccaacagcatccgggaaaggcccccaagctcatgatctacgacgtgtcaaaccggcccagcggagtgtccaatcgcttctccggctccaagtcgggcaatactgcctcgctgactatcagcggtctgcaagccgaagatgaggccgactattactgctcctcctacacctcgtcctccacactctacgtgttcggaaccggtactcagctgaccgtgcttggatcgcaccaccatcaccatcatcatcac

SEQ ID NO: 271 - protein, 284 aa, Artificial Sequence
  Description of Artificial Sequence: Synthetic polypeptide
MALPVTALLLPLALLLHAARPEVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSGGGGSGGGGSGGGGSQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVLGSHHHHHHHH

SEQ ID NO: 272 - protein, 497 aa, Artificial Sequence
  Description of Artificial Sequence: Synthetic polypeptide
MALPVTALLLPLALLLHAARPEVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSGGGGSGGGGSGGGGSQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 273 - DNA, 1491 bp, Artificial Sequence
  Description of Artificial Sequence: Synthetic polynucleotide
atggccctccctgtcaccgccctgctgcttccgctggctcttctgctccacgccgctcggcccgaagtgcagctgcagcagagcggaccgggcctggtcaaaccctcccaaaccctgtccctcacttgcgcgatctccggggactccgtgctctcgaactccgacacctggaactggattcggcagagcccatcgaggggcctggaatggctgggaagaacctaccaccggtccacttggtacgatgactacgcgagctcagtgcgcggacgcgtgtcgattaacgtggacacctccaagaaccagtacagcttgcaactgaacgccgtgacccctgaggacaccggagtgtactattgcgcccgggatagacttcaggacggaaacagctggtccgacgcctttgacgtctggggacagggcaccatggtcactgtgtcctcgggtggcggggggtccggtggaggaggttcaggcggaggcggctcacagtcagcactgacgcagccggcttccgcttccgggagccctggacagagcgtgaccatctcgtgtaccgggacttccagcgatgtcggcgggtacaactacgtgtcttggtaccaacagcatccgggaaaggcccccaagctcatgatctacgacgtgtcaaaccggcccagcggagtgtccaatcgcttctccggctccaagtcgggcaatactgcctcgctgactatcagcggtctgcaagccgaagatgaggccgactattactgctcctcctacacctcgtcctccacactctacgtgttcggaaccggtactcagctgaccgtgcttaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 274 - protein, 245 aa, Artificial Sequence
  Description of Artificial Sequence: Synthetic polypeptide
QVQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARGRMDTAMAQIWGQGTMVTVSSGDGGSGGGGSGGGGSNFMLTQPHSVSESPGKTVTIPCTGSSGSFASSYVQWYQQRPGSAPATVIYEDNQRPSGVPDRFSGSVDSSSNSASLTISGLKTEDEAVYYCQSYDGATWVFGGGTKLTVL

SEQ ID NO: 275 - DNA, 735 bp, Artificial Sequence
  Description of Artificial Sequence: Synthetic polynucleotide
caagtgcagctccaagaatcaggtcccggcctcgtgaagccttccgaaaccctctcccttacttgtaccgtgtccgggggaagcatctcgagcagctcctattactggggatggatcaggcagcctcccggaaagggactggagtggattggctccatctactactcggggtccacctactacaacccgtcactgaagtcccgcgtgaccatctcggtggatacctccaagaaccagttcagcctgaagctgtcctccgtgactgccgccgacactgccgtgtactactgcgcgcggggtcggatggacacagcgatggctcagatttggggacagggcaccatggtcactgtgtcctccggggatggaggctccgggggcggaggatctggtggcggggggtcgaacttcatgttgacccagccacactccgtgtcggaaagcccaggaaagaccgtcaccatcccttgcactggaagcagcggttcgttcgcatcaagctacgtgcagtggtaccagcaaagacccggcagcgctccggccaccgtcatctatgaggacaatcagcggccgtccggcgtgccggaccgcttcagcggatcggtggactcatcctcaaactccgcctccctgacgatttccggtctgaaaaccgaggacgaagccgtctactactgccagtcgtacgatggcgccacttgggtgtttggaggaggcaccaagctgaccgtgctg

SEQ ID NO: 276 - DNA, 828 bp, Artificial Sequence
  Description of Artificial Sequence: Synthetic polynucleotide
atggccctccctgtcaccgccctgctgcttccgctggctcttctgctccacgccgctcggccccaagtgcagctccaagaatcaggtcccggcctcgtgaagccttccgaaaccctctcccttacttgtaccgtgtccgggggaagcatctcgagcagctcctattactggggatggatcaggcagcctcccggaaagggactggagtggattggctccatctactactcggggtccacctactacaacccgtcactgaagtcccgcgtgaccatctcggtggatacctccaagaaccagttcagcctgaagctgtcctccgtgactgccgccgacactgccgtgtactactgcgcgcggggtcggatggacacagcgatggctcagatttggggacagggcaccatggtcactgtgtcctccggggatggaggctccgggggcggaggatctggtggcggggggtcgaacttcatgttgacccagccacactccgtgtcggaaagcccaggaaagaccgtcaccatcccttgcactggaagcagcggttcgttcgcatcaagctacgtgcagtggtaccagcaaagacccggcagcgctccggccaccgtcatctatgaggacaatcagcggccgtccggcgtgccggaccgcttcagcggatcggtggactcatcctcaaactccgcctccctgacgatttccggtctgaaaaccgaggacgaagccgtctactactgccagtcgtacgatggcgccacttgggtgtttggaggaggcaccaagctgaccgtgctgggatcgcaccaccatcaccatcatcatcac

SEQ ID NO: 277 - protein, 276 aa, Artificial Sequence
  Description of Artificial Sequence: Synthetic polypeptide
MALPVTALLLPLALLLHAARPQVQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARGRMDTAMAQIWGQGTMVTVSSGDGGSGGGGSGGGGSNFMLTQPHSVSESPGKTVTIPCTGSSGSFASSYVQWYQQRPGSAPATVIYEDNQRPSGVPDRFSGSVDSSSNSASLTISGLKTEDEAVYYCQSYDGATWVFGGGTKLTVLGSHHHHHHHH

SEQ ID NO: 278 - protein, 489 aa, Artificial Sequence
  Description of Artificial Sequence: Synthetic polypeptide
MALPVTALLLPLALLLHAARPQVQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARGRMDTAMAQIWGQGTMVTVSSGDGGSGGGGSGGGGSNFMLTQPHSVSESPGKTVTIPCTGSSGSFASSYVQWYQQRPGSAPATVIYEDNQRPSGVPDRFSGSVDSSSNSASLTISGLKTEDEAVYYCQSYDGATWVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 279 - DNA, 1467 bp, Artificial Sequence
  Description of Artificial Sequence: Synthetic polynucleotide
atggccctccctgtcaccgccctgctgcttccgctggctcttctgctccacgccgctcggccccaagtgcagctccaagaatcaggtcccggcctcgtgaagccttccgaaaccctctcccttacttgtaccgtgtccgggggaagcatctcgagcagctcctattactggggatggatcaggcagcctcccggaaagggactggagtggattggctccatctactactcggggtccacctactacaacccgtcactgaagtcccgcgtgaccatctcggtggatacctccaagaaccagttcagcctgaagctgtcctccgtgactgccgccgacactgccgtgtactactgcgcgcggggtcggatggacacagcgatggctcagatttggggacagggcaccatggtcactgtgtcctccggggatggaggctccgggggcggaggatctggtggcggggggtcgaacttcatgttgacccagccacactccgtgtcggaaagcccaggaaagaccgtcaccatcccttgcactggaagcagcggttcgttcgcatcaagctacgtgcagtggtaccagcaaagacccggcagcgctccggccaccgtcatctatgaggacaatcagcggccgtccggcgtgccggaccgcttcagcggatcggtggactcatcctcaaactccgcctccctgacgatttccggtctgaaaaccgaggacgaagccgtctactactgccagtcgtacgatggcgccacttgggtgtttggaggaggcaccaagctgaccgtgctgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 280 - protein, 242 aa, Artificial Sequence
  Description of Artificial Sequence: Synthetic polypeptide
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDLDVSLDIWGQGTMVTVSSGGGGSGGGGSGGGGSQSALTQPASVSGSPGQSITISCSGTSSDVGGYNSVSWYQQYPGKAPKLMIYDVNNRPSGVSSRFSGSKSGNTASLTISGLQAEDEADYYCSSYTSSSTLFFGAGTKVTVL

SEQ ID NO: 281 - DNA, 726 bp, Artificial Sequence
  Description of Artificial Sequence: Synthetic polynucleotide
caagtgcaacttgtccagagcggagcagaagtcaagaaaccaggagcaagcgtgaaggtgtcctgcaaagcgtcaggctacactttcacctcctactatatgcactgggtccgccaggcccctggacaaggcctggaatggatgggtatcatcaacccgtccggtggaagcaccagctacgcccagaagtttcagggaagagtgaccatgactcgggacacttcaacctcgacggtgtacatggagctgtcctccctgcggtcggaggacaccgccgtgtactactgcgcgagggatctcgatgtgtccctggacatttggggacagggcaccatggtcaccgtgtcctccggggggggcggatcaggcggcggaggttcagggggcgggggctcccagtccgcgctgactcagccggctagcgtgtccggctcgccgggacagagcattaccatctcgtgctcgggtaccagctccgacgtgggaggctataactccgtgtcctggtaccagcagtaccccggaaaggcccccaagctgatgatctacgacgtgaacaatcgcccttctggggtgtcctctcggttctccgggtcaaagagcggaaacaccgcctccctgaccatctcgggactccaagctgaggatgaagccgactactactgttcgagctacacctcctcctccactctcttcttcggtgccggaactaaggtcacagtgttg

SEQ ID NO: 282 - DNA, 819 bp, Artificial Sequence
  Description of Artificial Sequence: Synthetic polynucleotide
atggccctccctgtcaccgccctgctgcttccgctggctcttctgctccacgccgctcggccccaagtgcaacttgtccagagcggagcagaagtcaagaaaccaggagcaagcgtgaaggtgtcctgcaaagcgtcaggctacactttcacctcctactatatgcactgggtccgccaggcccctggacaaggcctggaatggatgggtatcatcaacccgtccggtggaagcaccagctacgcccagaagtttcagggaagagtgaccatgactcgggacacttcaacctcgacggtgtacatggagctgtcctccctgcggtcggaggacaccgccgtgtactactgcgcgagggatctcgatgtgtccctggacatttggggacagggcaccatggtcaccgtgtcctccggggggggcggatcaggcggcggaggttcagggggcgggggctcccagtccgcgctgactcagccggctagcgtgtccggctcgccgggacagagcattaccatctcgtgctcgggtaccagctccgacgtgggaggctataactccgtgtcctggtaccagcagtaccccggaaaggcccccaagctgatgatctacgacgtgaacaatcgcccttctggggtgtcctctcggttctccgggtcaaagagcggaaacaccgcctccctgaccatctcgggactccaagctgaggatgaagccgactactactgttcgagctacacctcctcctccactctcttcttcggtgccggaactaaggtcacagtgttgggatcgcaccaccatcaccatcatcatcac

SEQ ID NO: 283 - protein, 273 aa, Artificial Sequence
  Description of Artificial Sequence: Synthetic polypeptide
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDLDVSLDIWGQGTMVTVSSGGGGSGGGGSGGGGSQSALTQPASVSGSPGQSITISCSGTSSDVGGYNSVSWYQQYPGKAPKLMIYDVNNRPSGVSSRFSGSKSGNTASLTISGLQAEDEADYYCSSYTSSSTLFFGAGTKVTVLGSHHHHHHHH

SEQ ID NO: 284 - protein, 486 aa, Artificial Sequence
  Description of Artificial Sequence: Synthetic polypeptide
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDLDVSLDIWGQGTMVTVSSGGGGSGGGGSGGGGSQSALTQPASVSGSPGQSITISCSGTSSDVGGYNSVSWYQQYPGKAPKLMIYDVNNRPSGVSSRFSGSKSGNTASLTISGLQAEDEADYYCSSYTSSSTLFFGAGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 285 - DNA, 1458 bp, Artificial Sequence
  Description of Artificial Sequence: Synthetic polynucleotide
atggccctccctgtcaccgccctgctgcttccgctggctcttctgctccacgccgctcggccccaagtgcaacttgtccagagcggagcagaagtcaagaaaccaggagcaagcgtgaaggtgtcctgcaaagcgtcaggctacactttcacctcctactatatgcactgggtccgccaggcccctggacaaggcctggaatggatgggtatcatcaacccgtccggtggaagcaccagctacgcccagaagtttcagggaagagtgaccatgactcgggacacttcaacctcgacggtgtacatggagctgtcctccctgcggtcggaggacaccgccgtgtactactgcgcgagggatctcgatgtgtccctggacatttggggacagggcaccatggtcaccgtgtcctccggggggggcggatcaggcggcggaggttcagggggcgggggctcccagtccgcgctgactcagccggctagcgtgtccggctcgccgggacagagcattaccatctcgtgctcgggtaccagctccgacgtgggaggctataactccgtgtcctggtaccagcagtaccccggaaaggcccccaagctgatgatctacgacgtgaacaatcgcccttctggggtgtcctctcggttctccgggtcaaagagcggaaacaccgcctccctgaccatctcgggactccaagctgaggatgaagccgactactactgttcgagctacacctcctcctccactctcttcttcggtgccggaactaaggtcacagtgttgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 286 - protein, 247 aa, Artificial Sequence
  Description of Artificial Sequence: Synthetic polypeptide
EVQLVESGGGLVQPGGSLRLSCAASGFTFSSYAMHWVRQAPGKGLEYVSAISSNGGSTYYANSVKDRFTISRDNSKNTLYLQMGSLRAEDMAVYYCARVHSSGYYHPGPNDYWGQGTLVTVSSGGGGSGGGGSGGGGSSSELTQDPAVSVALGQTVRITCQGDSLRTYYATWYQQKPGQAPVLVFYDENNRPSGIPDRFSGSSSGNTASLTITGTQAEDEADYYCSSRDSSGNPSCVFGGGTKLTVL

SEQ ID NO: 287 - DNA, 741 bp, Artificial Sequence
  Description of Artificial Sequence: Synthetic polynucleotide
gaagtgcagttggtggagagcggtggaggacttgtgcaacctggaggatcattgagactgtcgtgtgcggcctccggctttaccttctcgtcctacgctatgcattgggtccgccaggcccccgggaaaggactcgaatacgtcagcgccatctcctcaaacgggggatcaacctactacgccaattccgtgaaggatcggttcaccatctcccgggataacagcaagaacaccctgtatctgcaaatggggtccctgagggcagaggacatggccgtctactactgcgcgcgcgtgcacagctctggatactaccaccctggaccgaacgattactggggccagggcactctcgtgaccgtgtcctcggggggtggtggaagcggcggcggaggatcggggggaggcggctcctcgagcgaactgacacaggaccctgccgtgtccgtggctctgggtcagactgtgcgcattacgtgtcaaggagactccctgagaacttattacgcgacctggtaccagcagaagccgggacaggcaccggtgctggtgttctacgacgaaaacaaccggccatccgggattcccgaccggttctccggctcatcgagcggcaacactgcctccctgaccatcaccgggacccaggccgaggacgaggccgattactactgctcctcgcgggactcctccggcaacccctcctgcgtgttcggcggtggaaccaagctgactgtcctc

SEQ ID NO: 288 - DNA, 834 bp, Artificial Sequence
  Description of Artificial Sequence: Synthetic polynucleotide
atggccctccctgtcaccgccctgctgcttccgctggctcttctgctccacgccgctcggcccgaagtgcagttggtggagagcggtggaggacttgtgcaacctggaggatcattgagactgtcgtgtgcggcctccggctttaccttctcgtcctacgctatgcattgggtccgccaggcccccgggaaaggactcgaatacgtcagcgccatctcctcaaacgggggatcaacctactacgccaattccgtgaaggatcggttcaccatctcccgggataacagcaagaacaccctgtatctgcaaatggggtccctgagggcagaggacatggccgtctactactgcgcgcgcgtgcacagctctggatactaccaccctggaccgaacgattactggggccagggcactctcgtgaccgtgtcctcggggggtggtggaagcggcggcggaggatcggggggaggcggctcctcgagcgaactgacacaggaccctgccgtgtccgtggctctgggtcagactgtgcgcattacgtgtcaaggagactccctgagaacttattacgcgacctggtaccagcagaagccgggacaggcaccggtgctggtgttctacgacgaaaacaaccggccatccgggattcccgaccggttctccggctcatcgagcggcaacactgcctccctgaccatcaccgggacccaggccgaggacgaggccgattactactgctcctcgcgggactcctccggcaacccctcctgcgtgttcggcggtggaaccaagctgactgtcctcggatcgcaccaccatcaccatcatcatcac

SEQ ID NO: 289 - protein, 278 aa, Artificial Sequence
  Description of Artificial Sequence: Synthetic polypeptide
MALPVTALLLPLALLLHAARPEVQLVESGGGLVQPGGSLRLSCAASGFTFSSYAMHWVRQAPGKGLEYVSAISSNGGSTYYANSVKDRFTISRDNSKNTLYLQMGSLRAEDMAVYYCARVHSSGYYHPGPNDYWGQGTLVTVSSGGGGSGGGGSGGGGSSSELTQDPAVSVALGQTVRITCQGDSLRTYYATWYQQKPGQAPVLVFYDENNRPSGIPDRFSGSSSGNTASLTITGTQAEDEADYYCSSRDSSGNPSCVFGGGTKLTVLGSHHHHHHHH

SEQ ID NO: 290 - protein, 491 aa, Artificial Sequence
  Description of Artificial Sequence: Synthetic polypeptide
MALPVTALLLPLALLLHAARPEVQLVESGGGLVQPGGSLRLSCAASGFTFSSYAMHWVRQAPGKGLEYVSAISSNGGSTYYANSVKDRFTISRDNSKNTLYLQMGSLRAEDMAVYYCARVHSSGYYHPGPNDYWGQGTLVTVSSGGGGSGGGGSGGGGSSSELTQDPAVSVALGQTVRITCQGDSLRTYYATWYQQKPGQAPVLVFYDENNRPSGIPDRFSGSSSGNTASLTITGTQAEDEADYYCSSRDSSGNPSCVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 291 - DNA, 1473 bp, Artificial Sequence
  Description of Artificial Sequence: Synthetic polynucleotide
atggccctccctgtcaccgccctgctgcttccgctggctcttctgctccacgccgctcggcccgaagtgcagttggtggagagcggtggaggacttgtgcaacctggaggatcattgagactgtcgtgtgcggcctccggctttaccttctcgtcctacgctatgcattgggtccgccaggcccccgggaaaggactcgaatacgtcagcgccatctcctcaaacgggggatcaacctactacgccaattccgtgaaggatcggttcaccatctcccgggataacagcaagaacaccctgtatctgcaaatggggtccctgagggcagaggacatggccgtctactactgcgcgcgcgtgcacagctctggatactaccaccctggaccgaacgattactggggccagggcactctcgtgaccgtgtcctcggggggtggtggaagcggcggcggaggatcggggggaggcggctcctcgagcgaactgacacaggaccctgccgtgtccgtggctctgggtcagactgtgcgcattacgtgtcaaggagactccctgagaacttattacgcgacctggtaccagcagaagccgggacaggcaccggtgctggtgttctacgacgaaaacaaccggccatccgggattcccgaccggttctccggctcatcgagcggcaacactgcctccctgaccatcaccgggacccaggccgaggacgaggccgattactactgctcctcgcgggactcctccggcaacccctcctgcgtgttcggcggtggaaccaagctgactgtcctcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 292 - protein, 243 aa, Artificial Sequence
  Description of Artificial Sequence: Synthetic polypeptide
EVQLVESGAEVKKPGASVKVSCKASGYTFTSYYMHWVRQAPGQGLEWMGIINPSGGSTSYAQKFQGRVTMTRDTSTSTAYMELSSLRSEDTAVYYCAREAGVVAVDYWGQGTLVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTWVFGGGTKLTVL

SEQ ID NO: 293 - DNA, 729 bp, Artificial Sequence
  Description of Artificial Sequence: Synthetic polynucleotide
gaagtgcaactcgtcgaatctggagcggaagtcaagaagcctggagcaagcgtgaaagtgtcctgtaaagcgtccggttacaccttcacttcgtattacatgcactgggtccgccaagctccgggacagggactggaatggatgggcatcatcaaccctagcggaggatcgacctcctacgcccaaaagttccagggcagagtgaccatgacccgggacaccagcacatcaactgcctacatggagctgtcatcactgaggtccgaggataccgccgtgtactattgcgcccgcgaggccggcgtggtggccgtcgactactggggacagggcactctcgtgaccgtgtcatcgggaggcggcggttccggggggggagggtcggggggcggaggctcccagtccgcactgacgcagccggcttccgtgtctggttcgcccggacagtccatcaccatttcctgcactggaaccagcagcgacgtgggcggttacaactacgtgtcatggtaccagcagcatcccggaaaggccccaaagcttatgatctacgacgtgtccaatcggccgtcgggcgtcagcaaccggttctccggctccaagtccgggaacactgccagcctgaccattagcgggctgcaggccgaggacgaagcggattactactgctcctcctacacttcctcctcgacctgggtgtttggtggaggcaccaagttgactgtgctg

SEQ ID NO: 294 - DNA, 822 bp, Artificial Sequence
  Description of Artificial Sequence: Synthetic polynucleotide
atggccctccctgtcaccgccctgctgcttccgctggctcttctgctccacgccgctcggcccgaagtgcaactcgtcgaatctggagcggaagtcaagaagcctggagcaagcgtgaaagtgtcctgtaaagcgtccggttacaccttcacttcgtattacatgcactgggtccgccaagctccgggacagggactggaatggatgggcatcatcaaccctagcggaggatcgacctcctacgcccaaaagttccagggcagagtgaccatgacccgggacaccagcacatcaactgcctacatggagctgtcatcactgaggtccgaggataccgccgtgtactattgcgcccgcgaggccggcgtggtggccgtcgactactggggacagggcactctcgtgaccgtgtcatcgggaggcggcggttccggggggggagggtcggggggcggaggctcccagtccgcactgacgcagccggcttccgtgtctggttcgcccggacagtccatcaccatttcctgcactggaaccagcagcgacgtgggcggttacaactacgtgtcatggtaccagcagcatcccggaaaggccccaaagcttatgatctacgacgtgtccaatcggccgtcgggcgtcagcaaccggttctccggctccaagtccgggaacactgccagcctgaccattagcgggctgcaggccgaggacgaagcggattactactgctcctcctacacttcctcctcgacctgggtgtttggtggaggcaccaagttgactgtgctgggatcgcaccaccatcaccatcatcatcac

SEQ ID NO: 295 - protein, 274 aa, Artificial Sequence
  Description of Artificial Sequence: Synthetic polypeptide
MALPVTALLLPLALLLHAARPEVQLVESGAEVKKPGASVKVSCKASGYTFTSYYMHWVRQAPGQGLEWMGIINPSGGSTSYAQKFQGRVTMTRDTSTSTAYMELSSLRSEDTAVYYCAREAGVVAVDYWGQGTLVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTWVFGGGTKLTVLGSHHHHHHHH

SEQ ID NO: 296 - protein, 487 aa, Artificial Sequence
  Description of Artificial Sequence: Synthetic polypeptide
MALPVTALLLPLALLLHAARPEVQLVESGAEVKKPGASVKVSCKASGYTFTSYYMHWVRQAPGQGLEWMGIINPSGGSTSYAQKFQGRVTMTRDTSTSTAYMELSSLRSEDTAVYYCAREAGVVAVDYWGQGTLVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTWVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 297 - DNA, 1461 bp, Artificial Sequence
  Description of Artificial Sequence: Synthetic polynucleotide
atggccctccctgtcaccgccctgctgcttccgctggctcttctgctccacgccgctcggcccgaagtgcaactcgtcgaatctggagcggaagtcaagaagcctggagcaagcgtgaaagtgtcctgtaaagcgtccggttacaccttcacttcgtattacatgcactgggtccgccaagctccgggacagggactggaatggatgggcatcatcaaccctagcggaggatcgacctcctacgcccaaaagttccagggcagagtgaccatgacccgggacaccagcacatcaactgcctacatggagctgtcatcactgaggtccgaggataccgccgtgtactattgcgcccgcgaggccggcgtggtggccgtcgactactggggacagggcactctcgtgaccgtgtcatcgggaggcggcggttccggggggggagggtcggggggcggaggctcccagtccgcactgacgcagccggcttccgtgtctggttcgcccggacagtccatcaccatttcctgcactggaaccagcagcgacgtgggcggttacaactacgtgtcatggtaccagcagcatcccggaaaggccccaaagcttatgatctacgacgtgtccaatcggccgtcgggcgtcagcaaccggttctccggctccaagtccgggaacactgccagcctgaccattagcgggctgcaggccgaggacgaagcggattactactgctcctcctacacttcctcctcgacctgggtgtttggtggaggcaccaagttgactgtgctgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 298 - protein, 250 aa, Artificial Sequence
  Description of Artificial Sequence: Synthetic polypeptide
QVQLVQSGGGVVQPGRSLRLSCAASGFTFSSYAMSWVRQAPGKGLEWVSAISGSGGSTYYADSVKGRFTISRDNSKNTLYLQMNSLRAEDTAVYYCAKEPLFGVVEEDVDYWGQGTLVTVSSGGGGSGGGGSGGGGSDVVMTQSPLSLPVTPGEPASISCRSSQSLLAGNGHNYLDWYLQKPGQSPQLLIYLGSNRASGVPDRFSGSGSGTDFTLKISRVEAEDVGVYYCMQALQNPLTFGGGTKLEIKR

SEQ ID NO: 299 - DNA, 750 bp, Artificial Sequence
  Description of Artificial Sequence: Synthetic polynucleotide
caagtgcagttggtccagagcggaggaggagtggtgcaacccggaagatcattgaggctctcatgtgctgcaagcggattcaccttctcgagctacgcaatgtcctgggtgcgccaggcccctggaaagggactggaatgggtgtccgccatctcgggctccggcggatcaacgtactacgccgactccgtgaagggccgctttactatttcaagagacaactccaagaacactctgtacctccaaatgaactctctgcgggccgaggacaccgccgtgtactactgcgcgaaggagccgctgttcggcgtggtggaggaagatgtggactactggggccagggcactctcgtcaccgtgtcctccggcggtggaggatcgggaggcggaggcagcgggggtggtggctccgacgtcgtgatgacccagtcgcccctgtccctgcccgtgacccctggggaaccggcctccatttcctgccggtccagccagtcgctgctggctggaaacggacacaattaccttgattggtatctgcaaaagcctgggcagtcaccgcagctgctgatctacctcggaagcaaccgggcgtccggggtgccggaccggttctccggttccgggagcggcaccgacttcaccctgaaaatctcgagggtggaggccgaagatgtcggagtgtactattgcatgcaggcgcttcagaacccactcactttcgggggcggtactaagctggaaatcaagcgc

SEQ ID NO: 300 - DNA, 843 bp, Artificial Sequence
  Description of Artificial Sequence: Synthetic polynucleotide
atggccctccctgtcaccgccctgctgcttccgctggctcttctgctccacgccgctcggccccaagtgcagttggtccagagcggaggaggagtggtgcaacccggaagatcattgaggctctcatgtgctgcaagcggattcaccttctcgagctacgcaatgtcctgggtgcgccaggcccctggaaagggactggaatgggtgtccgccatctcgggctccggcggatcaacgtactacgccgactccgtgaagggccgctttactatttcaagagacaactccaagaacactctgtacctccaaatgaactctctgcgggccgaggacaccgccgtgtactactgcgcgaaggagccgctgttcggcgtggtggaggaagatgtggactactggggccagggcactctcgtcaccgtgtcctccggcggtggaggatcgggaggcggaggcagcgggggtggtggctccgacgtcgtgatgacccagtcgcccctgtccctgcccgtgacccctggggaaccggcctccatttcctgccggtccagccagtcgctgctggctggaaacggacacaattaccttgattggtatctgcaaaagcctgggcagtcaccgcagctgctgatctacctcggaagcaaccgggcgtccggggtgccggaccggttctccggttccgggagcggcaccgacttcaccctgaaaatctcgagggtggaggccgaagatgtcggagtgtactattgcatgcaggcgcttcagaacccactcactttcgggggcggtactaagctggaaatcaagcgcggatcgcaccaccatcaccatcatcatcac

SEQ ID NO: 301 - protein, 281 aa, Artificial Sequence
  Description of Artificial Sequence: Synthetic polypeptide
MALPVTALLLPLALLLHAARPQVQLVQSGGGVVQPGRSLRLSCAASGFTFSSYAMSWVRQAPGKGLEWVSAISGSGGSTYYADSVKGRFTISRDNSKNTLYLQMNSLRAEDTAVYYCAKEPLFGVVEEDVDYWGQGTLVTVSSGGGGSGGGGSGGGGSDVVMTQSPLSLPVTPGEPASISCRSSQSLLAGNGHNYLDWYLQKPGQSPQLLIYLGSNRASGVPDRFSGSGSGTDFTLKISRVEAEDVGVYYCMQALQNPLTFGGGTKLEIKRGSHHHHHHHH

SEQ ID NO: 302 - protein, 494 aa, Artificial Sequence
  Description of Artificial Sequence: Synthetic polypeptide
MALPVTALLLPLALLLHAARPQVQLVQSGGGVVQPGRSLRLSCAASGFTFSSYAMSWVRQAPGKGLEWVSAISGSGGSTYYADSVKGRFTISRDNSKNTLYLQMNSLRAEDTAVYYCAKEPLFGVVEEDVDYWGQGTLVTVSSGGGGSGGGGSGGGGSDVVMTQSPLSLPVTPGEPASISCRSSQSLLAGNGHNYLDWYLQKPGQSPQLLIYLGSNRASGVPDRFSGSGSGTDFTLKISRVEAEDVGVYYCMQALQNPLTFGGGTKLEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 303 - DNA, 1482 bp, Artificial Sequence
  Description of Artificial Sequence: Synthetic polynucleotide
atggccctccctgtcaccgccctgctgcttccgctggctcttctgctccacgccgctcggccccaagtgcagttggtccagagcggaggaggagtggtgcaacccggaagatcattgaggctctcatgtgctgcaagcggattcaccttctcgagctacgcaatgtcctgggtgcgccaggcccctggaaagggactggaatgggtgtccgccatctcgggctccggcggatcaacgtactacgccgactccgtgaagggccgctttactatttcaagagacaactccaagaacactctgtacctccaaatgaactctctgcgggccgaggacaccgccgtgtactactgcgcgaaggagccgctgttcggcgtggtggaggaagatgtggactactggggccagggcactctcgtcaccgtgtcctccggcggtggaggatcgggaggcggaggcagcgggggtggtggctccgacgtcgtgatgacccagtcgcccctgtccctgcccgtgacccctggggaaccggcctccatttcctgccggtccagccagtcgctgctggctggaaacggacacaattaccttgattggtatctgcaaaagcctgggcagtcaccgcagctgctgatctacctcggaagcaaccgggcgtccggggtgccggaccggttctccggttccgggagcggcaccgacttcaccctgaaaatctcgagggtggaggccgaagatgtcggagtgtactattgcatgcaggcgcttcagaacccactcactttcgggggcggtactaagctggaaatcaagcgcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 304 - protein, 245 aa, Artificial Sequence
  Description of Artificial Sequence: Synthetic polypeptide
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARGSGSLGDAFDIWGQGTMVTVSSGGGGSGGGGSGGGGSQSALTQPASVSGSPGQSITISCTGSSSDVGGYNYVSWYQQHPGKAPKLMIYEVSNRPSGVSNRFSGSKSGNTASLTISGLQAEDEADYYCSSYTSSSTLVFGTGTKVTVL

SEQ ID NO: 305 - DNA, 735 bp, Artificial Sequence
  Description of Artificial Sequence: Synthetic polynucleotide
caagtccaactcgtccaaagcggagctgaagtcaagaagcctggagcgtcagtgaaagtgtcctgcaaggcctccggctacacgtttacttcctactacatgcattgggtgcggcaggccccaggtcaaggactggaatggatgggcatcattaacccttccggggggtccacctcgtatgcgcagaagttccagggcagagtgaccatgacccgcgacacctccacctccactgtgtacatggaactgtccagcctgaggtctgaggacactgccgtgtactactgtgcgcgcggtagcggatcactgggcgatgccttcgacatctggggccagggaactatggtcaccgtgtcctccgggggagggggctcgggtggaggaggttcaggcggaggaggctcccagagcgcattgacacagcccgcttcggtgtccggctccccgggacagtccattaccatctcgtgcaccggaagctcaagcgatgtcggagggtacaactacgtgtcgtggtatcagcagcacccgggaaaggcccccaagctcatgatctacgaagtgtccaatcggccgtccggggtgtcgaaccggttcagcggttccaagtcgggcaacactgccagcctgaccatcagcgggctgcaggccgaggacgaggccgactactactgctcctcgtacacctcctcctcaaccctggtgttcggcactggaactaaggtcaccgtgctt

SEQ ID NO: 306 - DNA, 828 bp, Artificial Sequence
  Description of Artificial Sequence: Synthetic polynucleotide
atggccctccctgtcaccgccctgctgcttccgctggctcttctgctccacgccgctcggccccaagtccaactcgtccaaagcggagctgaagtcaagaagcctggagcgtcagtgaaagtgtcctgcaaggcctccggctacacgtttacttcctactacatgcattgggtgcggcaggccccaggtcaaggactggaatggatgggcatcattaacccttccggggggtccacctcgtatgcgcagaagttccagggcagagtgaccatgacccgcgacacctccacctccactgtgtacatggaactgtccagcctgaggtctgaggacactgccgtgtactactgtgcgcgcggtagcggatcactgggcgatgccttcgacatctggggccagggaactatggtcaccgtgtcctccgggggagggggctcgggtggaggaggttcaggcggaggaggctcccagagcgcattgacacagcccgcttcggtgtccggctccccgggacagtccattaccatctcgtgcaccggaagctcaagcgatgtcggagggtacaactacgtgtcgtggtatcagcagcacccgggaaaggcccccaagctcatgatctacgaagtgtccaatcggccgtccggggtgtcgaaccggttcagcggttccaagtcgggcaacactgccagcctgaccatcagcgggctgcaggccgaggacgaggccgactactactgctcctcgtacacctcctcctcaaccctggtgttcggcactggaactaaggtcaccgtgcttggatcgcaccaccatcaccatcatcatcac

SEQ ID NO: 307 - protein, 276 aa, Artificial Sequence
  Description of Artificial Sequence: Synthetic polypeptide
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARGSGSLGDAFDIWGQGTMVTVSSGGGGSGGGGSGGGGSQSALTQPASVSGSPGQSITISCTGSSSDVGGYNYVSWYQQHPGKAPKLMIYEVSNRPSGVSNRFSGSKSGNTASLTISGLQAEDEADYYCSSYTSSSTLVFGTGTKVTVLGSHHHHHHHH

SEQ ID NO: 308 - protein, 489 aa, Artificial Sequence
  Description of Artificial Sequence: Synthetic polypeptide
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARGSGSLGDAFDIWGQGTMVTVSSGGGGSGGGGSGGGGSQSALTQPASVSGSPGQSITISCTGSSSDVGGYNYVSWYQQHPGKAPKLMIYEVSNRPSGVSNRFSGSKSGNTASLTISGLQAEDEADYYCSSYTSSSTLVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 309 - DNA, 1467 bp, Artificial Sequence
  Description of Artificial Sequence: Synthetic polynucleotide
atggccctccctgtcaccgccctgctgcttccgctggctcttctgctccacgccgctcggccccaagtccaactcgtccaaagcggagctgaagtcaagaagcctggagcgtcagtgaaagtgtcctgcaaggcctccggctacacgtttacttcctactacatgcattgggtgcggcaggccccaggtcaaggactggaatggatgggcatcattaacccttccggggggtccacctcgtatgcgcagaagttccagggcagagtgaccatgacccgcgacacctccacctccactgtgtacatggaactgtccagcctgaggtctgaggacactgccgtgtactactgtgcgcgcggtagcggatcactgggcgatgccttcgacatctggggccagggaactatggtcaccgtgtcctccgggggagggggctcgggtggaggaggttcaggcggaggaggctcccagagcgcattgacacagcccgcttcggtgtccggctccccgggacagtccattaccatctcgtgcaccggaagctcaagcgatgtcggagggtacaactacgtgtcgtggtatcagcagcacccgggaaaggcccccaagctcatgatctacgaagtgtccaatcggccgtccggggtgtcgaaccggttcagcggttccaagtcgggcaacactgccagcctgaccatcagcgggctgcaggccgaggacgaggccgactactactgctcctcgtacacctcctcctcaaccctggtgttcggcactggaactaaggtcaccgtgcttaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 310 - protein, 246 aa, Artificial Sequence
  Description of Artificial Sequence: Synthetic polypeptide
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDGFGELSGAFDIWGQGTMVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYASSSTLVFGGGTKVTVL

SEQ ID NO: 311 - DNA, 738 bp, Artificial Sequence
  Description of Artificial Sequence: Synthetic polynucleotide
caagtgcaactcgtccagtccggtgcagaagtcaagaaacccggagcctccgtgaaagtgtcctgcaaggcctccggctacacgttcacttcatactacatgcactgggtccgccaggcgcccggacagggactggagtggatgggcatcatcaacccttccggcggctcgacctcctacgcccaaaagttccagggaagagtgacaatgaccagggatacttcaaccagcactgtctacatggaactgtctagcttgcggtccgaggacactgccgtgtactattgcgctcgggacggtttcggggagctgtccggggcctttgacatctggggccaggggactatggtgaccgtgtcctcgggcggaggcggcagcggaggaggaggttcgggaggcggaggaagccagtcagcactgacccagccagcctcggtgtccgggagcccgggccagagcatcactatttcctgtaccgggacctcctccgacgtgggagggtacaattacgtgtcatggtatcaacagcatccgggaaaggcgccgaagctgatgatctacgacgtgtcgaaccgccctagcggagtgtccaaccggttctccggttcgaagtccgggaacaccgcgagcctgaccattagcggactccaggccgaggatgaagccgactactactgctcctcctacgcttcatcgtccaccctggtgttcggtggtggcaccaaggtcaccgtgctt

SEQ ID NO: 312 - DNA, 831 bp, Artificial Sequence
  Description of Artificial Sequence: Synthetic polynucleotide
atggccctccctgtcaccgccctgctgcttccgctggctcttctgctccacgccgctcggccccaagtgcaactcgtccagtccggtgcagaagtcaagaaacccggagcctccgtgaaagtgtcctgcaaggcctccggctacacgttcacttcatactacatgcactgggtccgccaggcgcccggacagggactggagtggatgggcatcatcaacccttccggcggctcgacctcctacgcccaaaagttccagggaagagtgacaatgaccagggatacttcaaccagcactgtctacatggaactgtctagcttgcggtccgaggacactgccgtgtactattgcgctcgggacggtttcggggagctgtccggggcctttgacatctggggccaggggactatggtgaccgtgtcctcgggcggaggcggcagcggaggaggaggttcgggaggcggaggaagccagtcagcactgacccagccagcctcggtgtccgggagcccgggccagagcatcactatttcctgtaccgggacctcctccgacgtgggagggtacaattacgtgtcatggtatcaacagcatccgggaaaggcgccgaagctgatgatctacgacgtgtcgaaccgccctagcggagtgtccaaccggttctccggttcgaagtccgggaacaccgcgagcctgaccattagcggactccaggccgaggatgaagccgactactactgctcctcctacgcttcatcgtccaccctggtgttcggtggtggcaccaaggtcaccgtgcttggatcgcaccaccatcaccatcatcatcac

SEQ ID NO: 313 - protein, 277 aa, Artificial Sequence
  Description of Artificial Sequence: Synthetic polypeptide
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDGFGELSGAFDIWGQGTMVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYASSSTLVFGGGTKVTVLGSHHHHHHHH

SEQ ID NO: 314 - protein, 490 aa, Artificial Sequence
  Description of Artificial Sequence: Synthetic polypeptide
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDGFGELSGAFDIWGQGTMVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYASSSTLVFGGGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 315 - DNA, 1470 bp, Artificial Sequence
  Description of Artificial Sequence: Synthetic polynucleotide
atggccctccctgtcaccgccctgctgcttccgctggctcttctgctccacgccgctcggccccaagtgcaactcgtccagtccggtgcagaagtcaagaaacccggagcctccgtgaaagtgtcctgcaaggcctccggctacacgttcacttcatactacatgcactgggtccgccaggcgcccggacagggactggagtggatgggcatcatcaacccttccggcggctcgacctcctacgcccaaaagttccagggaagagtgacaatgaccagggatacttcaaccagcactgtctacatggaactgtctagcttgcggtccgaggacactgccgtgtactattgcgctcgggacggtttcggggagctgtccggggcctttgacatctggggccaggggactatggtgaccgtgtcctcgggcggaggcggcagcggaggaggaggttcgggaggcggaggaagccagtcagcactgacccagccagcctcggtgtccgggagcccgggccagagcatcactatttcctgtaccgggacctcctccgacgtgggagggtacaattacgtgtcatggtatcaacagcatccgggaaaggcgccgaagctgatgatctacgacgtgtcgaaccgccctagcggagtgtccaaccggttctccggttcgaagtccgggaacaccgcgagcctgaccattagcggactccaggccgaggatgaagccgactactactgctcctcctacgcttcatcgtccaccctggtgttcggtggtggcaccaaggtcaccgtgcttaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 316 - protein, 247 aa, Artificial Sequence
  Description of Artificial Sequence: Synthetic polypeptide
EVQLVESGAEVKKPGASVKVSCKASGYTFTSYYMHWVRQAPGQGLEWMGIINPSGGSTSYAQKFQGRVTMTRDTSTSTVYMELSSLRSEDTAVYYCARGPIGCSGGSCLDYWGQGTLVTVSSGGGGSGGGGSGGGGSQSALTQPAYVSGSPGQSITISCTGTNSDVGRYNYVSWYQQHPGKAPKLMIYEVSYRPSGVSNRFSGSKSGNTASLTISGLQAEDEADYYCSSYTTSSTLDFGTGTKVTVL

SEQ ID NO: 317 - DNA, 741 bp, Artificial Sequence
  Description of Artificial Sequence: Synthetic polynucleotide
gaagtgcaactcgtcgaatcaggagcagaagtcaagaaaccaggagcctccgtgaaagtcagctgcaaggcctcgggctacactttcacttcctactacatgcattgggtgcgccaggccccgggccagggactggaatggatgggcatcatcaatccctcgggaggttccactagctacgcgcagaagttccagggaagagtgaccatgaccagagacacctcgacttcgacggtgtacatggagctgagctccctgaggagcgaggacactgccgtgtactactgcgcccggggcccgatcggatgcagcggggggtcctgtctcgattactggggccagggcacactcgtgaccgtgtccagcgggggcggtggtagcggaggagggggatcgggcggtggaggatcgcagtccgccctgacccaaccggcgtacgtgtctggatcacccggacagtccattaccatctcctgcaccggaaccaactcggacgtgggccgctacaactacgtgtcatggtaccagcagcaccccgggaaggctcctaagctgatgatctacgaggtgtcctatcggcctagcggtgtcagcaaccggttctccggctccaagtccggcaacactgcttcccttaccatttccgggttgcaagccgaggacgaggccgattactactgttcctcctataccacttcatccaccctggactttggaaccggcaccaaggtcaccgtgctg

SEQ ID NO: 318 - DNA, 834 bp, Artificial Sequence
  Description of Artificial Sequence: Synthetic polynucleotide
atggccctccctgtcaccgccctgctgcttccgctggctcttctgctccacgccgctcggcccgaagtgcaactcgtcgaatcaggagcagaagtcaagaaaccaggagcctccgtgaaagtcagctgcaaggcctcgggctacactttcacttcctactacatgcattgggtgcgccaggccccgggccagggactggaatggatgggcatcatcaatccctcgggaggttccactagctacgcgcagaagttccagggaagagtgaccatgaccagagacacctcgacttcgacggtgtacatggagctgagctccctgaggagcgaggacactgccgtgtactactgcgcccggggcccgatcggatgcagcggggggtcctgtctcgattactggggccagggcacactcgtgaccgtgtccagcgggggcggtggtagcggaggagggggatcgggcggtggaggatcgcagtccgccctgacccaaccggcgtacgtgtctggatcacccggacagtccattaccatctcctgcaccggaaccaactcggacgtgggccgctacaactacgtgtcatggtaccagcagcaccccgggaaggctcctaagctgatgatctacgaggtgtcctatcggcctagcggtgtcagcaaccggttctccggctccaagtccggcaacactgcttcccttaccatttccgggttgcaagccgaggacgaggccgattactactgttcctcctataccacttcatccaccctggactttggaaccggcaccaaggtcaccgtgctgggatcgcaccaccatcaccatcatcatcac

SEQ ID NO: 319 - protein, 278 aa, Artificial Sequence
  Description of Artificial Sequence: Synthetic polypeptide
MALPVTALLLPLALLLHAARPEVQLVESGAEVKKPGASVKVSCKASGYTFTSYYMHWVRQAPGQGLEWMGIINPSGGSTSYAQKFQGRVTMTRDTSTSTVYMELSSLRSEDTAVYYCARGPIGCSGGSCLDYWGQGTLVTVSSGGGGSGGGGSGGGGSQSALTQPAYVSGSPGQSITISCTGTNSDVGRYNYVSWYQQHPGKAPKLMIYEVSYRPSGVSNRFSGSKSGNTASLTISGLQAEDEADYYCSSYTTSSTLDFGTGTKVTVLGSHHHHHHHH

SEQ ID NO: 320 - protein, 491 aa, Artificial Sequence
  Description of Artificial Sequence: Synthetic polypeptide
MALPVTALLLPLALLLHAARPEVQLVESGAEVKKPGASVKVSCKASGYTFTSYYMHWVRQAPGQGLEWMGIINPSGGSTSYAQKFQGRVTMTRDTSTSTVYMELSSLRSEDTAVYYCARGPIGCSGGSCLDYWGQGTLVTVSSGGGGSGGGGSGGGGSQSALTQPAYVSGSPGQSITISCTGTNSDVGRYNYVSWYQQHPGKAPKLMIYEVSYRPSGVSNRFSGSKSGNTASLTISGLQAEDEADYYCSSYTTSSTLDFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 321 - DNA, 1473 bp, Artificial Sequence
  Description of Artificial Sequence: Synthetic polynucleotide
atggccctccctgtcaccgccctgctgcttccgctggctcttctgctccacgccgctcggcccgaagtgcaactcgtcgaatcaggagcagaagtcaagaaaccaggagcctccgtgaaagtcagctgcaaggcctcgggctacactttcacttcctactacatgcattgggtgcgccaggccccgggccagggactggaatggatgggcatcatcaatccctcgggaggttccactagctacgcgcagaagttccagggaagagtgaccatgaccagagacacctcgacttcgacggtgtacatggagctgagctccctgaggagcgaggacactgccgtgtactactgcgcccggggcccgatcggatgcagcggggggtcctgtctcgattactggggccagggcacactcgtgaccgtgtccagcgggggcggtggtagcggaggagggggatcgggcggtggaggatcgcagtccgccctgacccaaccggcgtacgtgtctggatcacccggacagtccattaccatctcctgcaccggaaccaactcggacgtgggccgctacaactacgtgtcatggtaccagcagcaccccgggaaggctcctaagctgatgatctacgaggtgtcctatcggcctagcggtgtcagcaaccggttctccggctccaagtccggcaacactgcttcccttaccatttccgggttgcaagccgaggacgaggccgattactactgttcctcctataccacttcatccaccctggactttggaaccggcaccaaggtcaccgtgctgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 322 - protein, 246 aa, Artificial Sequence
  Description of Artificial Sequence: Synthetic polypeptide
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARGSYGDYGDAFDIWGQGTTVTVSSGGGGSGGGGSGSGGSQSALTQPASVSGSPGQSITISCTGTSSDVGGYKYVSWYQQHPGKAPKLMIYDVSNRPSGVSNRFSGSKSGNTASLTISGLQAEDEADYYCSSYTSSSTLVFGGGTKLTVL

SEQ ID NO: 323 - DNA, 738 bp, Artificial Sequence
  Description of Artificial Sequence: Synthetic polynucleotide
caagtgcaactcgtccagtccggtgcagaagtcaagaaacccggagcctccgtgaaagtgtcctgcaaggcctcgggctacaccttcacctcctactacatgcactgggtgcgccaggcgccgggccagggacttgagtggatgggtatcatcaacccgtccggcggaagcacctcgtacgcccaaaagtttcaggggagagtgaccatgaccagggacacttcaaccagcaccgtgtacatggaactgtcaagcttgcgctccgaggatactgccgtctactactgcgcccggggatcgtacggagactacggcgacgctttcgatatctggggacagggcacaaccgtgaccgtgtcctccggcggagggggctcgggcggaggaggctcaggttccggcgggagccagtccgcactgactcagccagcgtccgtgagcggtagccctgggcagtctatcacgatttcgtgcactggcacctcctccgacgtgggaggctataagtacgtcagctggtaccaacagcatccgggaaaggcgcctaagctgatgatctatgacgtcagcaaccggccctccggggtgtcaaaccggttcagcggttccaagtcgggaaataccgcctccctgaccattagcgggctgcaggccgaagatgaggctgactactactgttcctcctacacttcatcgtccactctcgtgttcgggggaggaactaagctcaccgtgctg

SEQ ID NO: 324 - DNA, 831 bp, Artificial Sequence
  Description of Artificial Sequence: Synthetic polynucleotide
atggccctccctgtcaccgccctgctgcttccgctggctcttctgctccacgccgctcggccccaagtgcaactcgtccagtccggtgcagaagtcaagaaacccggagcctccgtgaaagtgtcctgcaaggcctcgggctacaccttcacctcctactacatgcactgggtgcgccaggcgccgggccagggacttgagtggatgggtatcatcaacccgtccggcggaagcacctcgtacgcccaaaagtttcaggggagagtgaccatgaccagggacacttcaaccagcaccgtgtacatggaactgtcaagcttgcgctccgaggatactgccgtctactactgcgcccggggatcgtacggagactacggcgacgctttcgatatctggggacagggcacaaccgtgaccgtgtcctccggcggagggggctcgggcggaggaggctcaggttccggcgggagccagtccgcactgactcagccagcgtccgtgagcggtagccctgggcagtctatcacgatttcgtgcactggcacctcctccgacgtgggaggctataagtacgtcagctggtaccaacagcatccgggaaaggcgcctaagctgatgatctatgacgtcagcaaccggccctccggggtgtcaaaccggttcagcggttccaagtcgggaaataccgcctccctgaccattagcgggctgcaggccgaagatgaggctgactactactgttcctcctacacttcatcgtccactctcgtgttcgggggaggaactaagctcaccgtgctgggatcgcaccaccatcaccatcatcatcac

SEQ ID NO: 325 - protein, 277 aa, Artificial Sequence
  Description of Artificial Sequence: Synthetic polypeptide
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARGSYGDYGDAFDIWGQGTTVTVSSGGGGSGGGGSGSGGSQSALTQPASVSGSPGQSITISCTGTSSDVGGYKYVSWYQQHPGKAPKLMIYDVSNRPSGVSNRFSGSKSGNTASLTISGLQAEDEADYYCSSYTSSSTLVFGGGTKLTVLGSHHHHHHHH

SEQ ID NO: 326 - protein, 490 aa, Artificial Sequence
  Description of Artificial Sequence: Synthetic polypeptide
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARGSYGDYGDAFDIWGQGTTVTVSSGGGGSGGGGSGSGGSQSALTQPASVSGSPGQSITISCTGTSSDVGGYKYVSWYQQHPGKAPKLMIYDVSNRPSGVSNRFSGSKSGNTASLTISGLQAEDEADYYCSSYTSSSTLVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 327 - DNA, 1470 bp, Artificial Sequence
  Description of Artificial Sequence: Synthetic polynucleotide
atggccctccctgtcaccgccctgctgcttccgctggctcttctgctccacgccgctcggccccaagtgcaactcgtccagtccggtgcagaagtcaagaaacccggagcctccgtgaaagtgtcctgcaaggcctcgggctacaccttcacctcctactacatgcactgggtgcgccaggcgccgggccagggacttgagtggatgggtatcatcaacccgtccggcggaagcacctcgtacgcccaaaagtttcaggggagagtgaccatgaccagggacacttcaaccagcaccgtgtacatggaactgtcaagcttgcgctccgaggatactgccgtctactactgcgcccggggatcgtacggagactacggcgacgctttcgatatctggggacagggcacaaccgtgaccgtgtcctccggcggagggggctcgggcggaggaggctcaggttccggcgggagccagtccgcactgactcagccagcgtccgtgagcggtagccctgggcagtctatcacgatttcgtgcactggcacctcctccgacgtgggaggctataagtacgtcagctggtaccaacagcatccgggaaaggcgcctaagctgatgatctatgacgtcagcaaccggccctccggggtgtcaaaccggttcagcggttccaagtcgggaaataccgcctccctgaccattagcgggctgcaggccgaagatgaggctgactactactgttcctcctacacttcatcgtccactctcgtgttcgggggaggaactaagctcaccgtgctgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 328 - protein, 244 aa, Artificial Sequence
  Description of Artificial Sequence: Synthetic polypeptide
EVQLVESGAEVKKPGSSVKVSCKASGGTFSSYAISWVRQAPGQGLEWMGGIIPIFGTANYAQKFQGRVTITADESTSTAYMELSSLRSEDTAVYYCARDHKVVRFGYWGQGTLVTVSSGGGGSGGGGSGGGGSHVILTQPPSASASLGASVKLTCTLSSGHSSYAIAWHQQQPEKGPRYLMKVNSDGSLSKGDGIPDRFSGSTSGAERYLTISSLQSEDEADYYCQTWGSGMAIFGGGTKLTVL

SEQ ID NO: 329 - DNA, 732 bp, Artificial Sequence
  Description of Artificial Sequence: Synthetic polynucleotide
gaagtgcaattggtggaatcaggcgcagaagtcaagaaacccggaagcagcgtgaaagtgtcctgcaaggcctcaggaggcaccttctcgtcctatgccatttcctgggtccgccaggccccgggacagggcctggaatggatgggcggaattatccctatcttcggaaccgcgaactacgcccagaagtttcagggacgcgtgaccatcactgccgatgaatcaacctccactgcgtacatggaactgtcctccctgcggagcgaggacaccgccgtgtactactgcgcaagggatcataaggtcgtgcggttcggatactggggacagggaacccttgtgaccgtgtcctccggcggcggggggtccggcggagggggttccgggggaggcggatcgcacgtgatcctgactcaaccaccctcagcctccgcctctctgggagccagcgtgaagctcacctgtactctgagctcgggacactcgtcgtacgccatcgcttggcaccagcagcagccggagaaggggcctagatacctgatgaaggtcaactccgacggttcgctgagcaagggcgacggcatcccggatcggttcagcggttccacgtccggcgcggagagatacctcacaatctcctcgctccaatccgaggacgaggctgactactactgccagacctggggtagcggcatggcgattttcgggggtggaactaagctgaccgtgctg

SEQ ID NO: 330 - DNA, 825 bp, Artificial Sequence
  Description of Artificial Sequence: Synthetic polynucleotide
atggccctccctgtcaccgccctgctgcttccgctggctcttctgctccacgccgctcggcccgaagtgcaattggtggaatcaggcgcagaagtcaagaaacccggaagcagcgtgaaagtgtcctgcaaggcctcaggaggcaccttctcgtcctatgccatttcctgggtccgccaggccccgggacagggcctggaatggatgggcggaattatccctatcttcggaaccgcgaactacgcccagaagtttcagggacgcgtgaccatcactgccgatgaatcaacctccactgcgtacatggaactgtcctccctgcggagcgaggacaccgccgtgtactactgcgcaagggatcataaggtcgtgcggttcggatactggggacagggaacccttgtgaccgtgtcctccggcggcggggggtccggcggagggggttccgggggaggcggatcgcacgtgatcctgactcaaccaccctcagcctccgcctctctgggagccagcgtgaagctcacctgtactctgagctcgggacactcgtcgtacgccatcgcttggcaccagcagcagccggagaaggggcctagatacctgatgaaggtcaactccgacggttcgctgagcaagggcgacggcatcccggatcggttcagcggttccacgtccggcgcggagagatacctcacaatctcctcgctccaatccgaggacgaggctgactactactgccagacctggggtagcggcatggcgattttcgggggtggaactaagctgaccgtgctgggatcgcaccaccatcaccatcatcatcac

SEQ ID NO: 331 - protein, 275 aa, Artificial Sequence
  Description of Artificial Sequence: Synthetic polypeptide
MALPVTALLLPLALLLHAARPEVQLVESGAEVKKPGSSVKVSCKASGGTFSSYAISWVRQAPGQGLEWMGGIIPIFGTANYAQKFQGRVTITADESTSTAYMELSSLRSEDTAVYYCARDHKVVRFGYWGQGTLVTVSSGGGGSGGGGSGGGGSHVILTQPPSASASLGASVKLTCTLSSGHSSYAIAWHQQQPEKGPRYLMKVNSDGSLSKGDGIPDRFSGSTSGAERYLTISSLQSEDEADYYCQTWGSGMAIFGGGTKLTVLGSHHHHHHHH

SEQ ID NO: 332 - protein, 488 aa, Artificial Sequence
  Description of Artificial Sequence: Synthetic polypeptide
MALPVTALLLPLALLLHAARPEVQLVESGAEVKKPGSSVKVSCKASGGTFSSYAISWVRQAPGQGLEWMGGIIPIFGTANYAQKFQGRVTITADESTSTAYMELSSLRSEDTAVYYCARDHKVVRFGYWGQGTLVTVSSGGGGSGGGGSGGGGSHVILTQPPSASASLGASVKLTCTLSSGHSSYAIAWHQQQPEKGPRYLMKVNSDGSLSKGDGIPDRFSGSTSGAERYLTISSLQSEDEADYYCQTWGSGMAIFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 333 - DNA, 1464 bp, Artificial Sequence
  Description of Artificial Sequence: Synthetic polynucleotide
atggccctccctgtcaccgccctgctgcttccgctggctcttctgctccacgccgctcggcccgaagtgcaattggtggaatcaggcgcagaagtcaagaaacccggaagcagcgtgaaagtgtcctgcaaggcctcaggaggcaccttctcgtcctatgccatttcctgggtccgccaggccccgggacagggcctggaatggatgggcggaattatccctatcttcggaaccgcgaactacgcccagaagtttcagggacgcgtgaccatcactgccgatgaatcaacctccactgcgtacatggaactgtcctccctgcggagcgaggacaccgccgtgtactactgcgcaagggatcataaggtcgtgcggttcggatactggggacagggaacccttgtgaccgtgtcctccggcggcggggggtccggcggagggggttccgggggaggcggatcgcacgtgatcctgactcaaccaccctcagcctccgcctctctgggagccagcgtgaagctcacctgtactctgagctcgggacactcgtcgtacgccatcgcttggcaccagcagcagccggagaaggggcctagatacctgatgaaggtcaactccgacggttcgctgagcaagggcgacggcatcccggatcggttcagcggttccacgtccggcgcggagagatacctcacaatctcctcgctccaatccgaggacgaggctgactactactgccagacctggggtagcggcatggcgattttcgggggtggaactaagctgaccgtgctgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 334 - protein, 241 aa, Artificial Sequence
  Description of Artificial Sequence: Synthetic polypeptide
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARGDYYMDVWGKGTTVTVSSGGGGSGGGGSGGGGSQSALTQPASASGSPGQSVTISCTGTSSDVGGYNYVSWYQQHPGKAPKLMIYEVSKRPSGVPDRFSGSKSGNTASLTISGLQAEDEADYYCSSYTSSGTLVFGGGTKLTVL

SEQ ID NO: 335 - DNA, 723 bp, Artificial Sequence
  Description of Artificial Sequence: Synthetic polynucleotide
caagtgcaactcgtccagtccggtgcagaagtcaagaaacccggtgcttccgtgaaagtgtcctgcaaggcctcaggttacaccttcacctcctactacatgcattgggtccgccaagcccccggacaaggcctggagtggatgggaattatcaacccgtccggcggcagcacaagctacgcccagaagttccagggacgcgtgactatgaccagagatacctccacctccaccgtgtacatggaactgtcctcactccggtcggaagataccgccgtgtactactgtgcccggggagactactatatggacgtctggggaaagggcaccaccgtgactgtgtcgtcgggcggcgggggttcgggaggaggaggaagcggtggcgggggaagccagtccgcactgactcagcccgcgtcggccagcgggagccctggccagagcgtgaccatttcgtgcaccggaacttcctctgacgtcggcggatacaactacgtgtcctggtaccagcagcaccctggaaaggccccgaagctgatgatctacgaggtgtccaagaggccatccggcgtgccggaccggttttcgggatcaaagtccgggaacacggccagcctgaccatcagcgggcttcaggctgaggacgaagcggattactactgctcctcctatacttcatccggcaccttggtgttcggcggagggactaagctgactgtgctc

SEQ ID NO: 336 - DNA, 816 bp, Artificial Sequence
  Description of Artificial Sequence: Synthetic polynucleotide
atggccctccctgtcaccgccctgctgcttccgctggctcttctgctccacgccgctcggccccaagtgcaactcgtccagtccggtgcagaagtcaagaaacccggtgcttccgtgaaagtgtcctgcaaggcctcaggttacaccttcacctcctactacatgcattgggtccgccaagcccccggacaaggcctggagtggatgggaattatcaacccgtccggcggcagcacaagctacgcccagaagttccagggacgcgtgactatgaccagagatacctccacctccaccgtgtacatggaactgtcctcactccggtcggaagataccgccgtgtactactgtgcccggggagactactatatggacgtctggggaaagggcaccaccgtgactgtgtcgtcgggcggcgggggttcgggaggaggaggaagcggtggcgggggaagccagtccgcactgactcagcccgcgtcggccagcgggagccctggccagagcgtgaccatttcgtgcaccggaacttcctctgacgtcggcggatacaactacgtgtcctggtaccagcagcaccctggaaaggccccgaagctgatgatctacgaggtgtccaagaggccatccggcgtgccggaccggttttcgggatcaaagtccgggaacacggccagcctgaccatcagcgggcttcaggctgaggacgaagcggattactactgctcctcctatacttcatccggcaccttggtgttcggcggagggactaagctgactgtgctcggatcgcaccaccatcaccatcatcatcac

SEQ ID NO: 337 - protein, 272 aa, Artificial Sequence
  Description of Artificial Sequence: Synthetic polypeptide
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARGDYYMDVWGKGTTVTVSSGGGGSGGGGSGGGGSQSALTQPASASGSPGQSVTISCTGTSSDVGGYNYVSWYQQHPGKAPKLMIYEVSKRPSGVPDRFSGSKSGNTASLTISGLQAEDEADYYCSSYTSSGTLVFGGGTKLTVLGSHHHHHHHH

SEQ ID NO: 338 - protein, 485 aa, Artificial Sequence
  Description of Artificial Sequence: Synthetic polypeptide
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARGDYYMDVWGKGTTVTVSSGGGGSGGGGSGGGGSQSALTQPASASGSPGQSVTISCTGTSSDVGGYNYVSWYQQHPGKAPKLMIYEVSKRPSGVPDRFSGSKSGNTASLTISGLQAEDEADYYCSSYTSSGTLVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 339 - DNA, 1455 bp, Artificial Sequence
  Description of Artificial Sequence: Synthetic polynucleotide
atggccctccctgtcaccgccctgctgcttccgctggctcttctgctccacgccgctcggccccaagtgcaactcgtccagtccggtgcagaagtcaagaaacccggtgcttccgtgaaagtgtcctgcaaggcctcaggttacaccttcacctcctactacatgcattgggtccgccaagcccccggacaaggcctggagtggatgggaattatcaacccgtccggcggcagcacaagctacgcccagaagttccagggacgcgtgactatgaccagagatacctccacctccaccgtgtacatggaactgtcctcactccggtcggaagataccgccgtgtactactgtgcccggggagactactatatggacgtctggggaaagggcaccaccgtgactgtgtcgtcgggcggcgggggttcgggaggaggaggaagcggtggcgggggaagccagtccgcactgactcagcccgcgtcggccagcgggagccctggccagagcgtgaccatttcgtgcaccggaacttcctctgacgtcggcggatacaactacgtgtcctggtaccagcagcaccctggaaaggccccgaagctgatgatctacgaggtgtccaagaggccatccggcgtgccggaccggttttcgggatcaaagtccgggaacacggccagcctgaccatcagcgggcttcaggctgaggacgaagcggattactactgctcctcctatacttcatccggcaccttggtgttcggcggagggactaagctgactgtgctcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 340 - protein, 247 aa, Artificial Sequence
  Description of Artificial Sequence: Synthetic polypeptide
EVQLVESGGGLVQPGGSLRLSCAASGFTFSSYAMSWVRQAPGKGLEWVSYISSSSSTIYYADSVKGRFTISRDNAKNSLYLQMNSLRAEDTAVYYCARDGPIRYFDHSKAFDIWGQGTMVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYRNSRDSSGNPYVFGTGTKVTVL

SEQ ID NO: 341 - DNA, 741 bp, Artificial Sequence
  Description of Artificial Sequence: Synthetic polynucleotide
gaagtgcaattggtggaatcaggaggaggacttgtgcaacctggaggatctctgagactgtcatgcgccgcgtcgggattcactttctcctcctacgcaatgtcgtgggtcagacaggcccccggaaagggcctggaatgggtgtcatacatcagctcctcctcctccacgatctactacgccgactctgtgaaggggcggttcaccattagccgggacaacgcaaagaactccctgtatctgcaaatgaacagcctcagggcggaagataccgccgtgtactactgtgcgcgcgatggtccgattcgctatttcgaccactccaaggccttcgatatctggggccagggaaccatggtcaccgtgtcgtccggtggaggcggcagcggggggggcggaagcggcggcgggggttcatcctcggagctgactcaggaccccgccgtgtccgtggctctgggacagaccgtgcgcatcacatgccagggagattccctgcggtcgtactacgcctcctggtaccagcagaaaccgggccaggcccccgtcctcgtgatctacggaaagaacaacaggccttcgggtatcccagaccggttcagcggcagctccagcggaaacaccgcaagcctcactattaccggggcccaggctgaggacgaggccgactactaccggaactcccgcgactcctcgggcaatccgtacgtctttggtactgggaccaaggtcaccgtgctg

SEQ ID NO: 342 - DNA, 834 bp, Artificial Sequence
  Description of Artificial Sequence: Synthetic polynucleotide
atggccctccctgtcaccgccctgctgcttccgctggctcttctgctccacgccgctcggcccgaagtgcaattggtggaatcaggaggaggacttgtgcaacctggaggatctctgagactgtcatgcgccgcgtcgggattcactttctcctcctacgcaatgtcgtgggtcagacaggcccccggaaagggcctggaatgggtgtcatacatcagctcctcctcctccacgatctactacgccgactctgtgaaggggcggttcaccattagccgggacaacgcaaagaactccctgtatctgcaaatgaacagcctcagggcggaagataccgccgtgtactactgtgcgcgcgatggtccgattcgctatttcgaccactccaaggccttcgatatctggggccagggaaccatggtcaccgtgtcgtccggtggaggcggcagcggggggggcggaagcggcggcgggggttcatcctcggagctgactcaggaccccgccgtgtccgtggctctgggacagaccgtgcgcatcacatgccagggagattccctgcggtcgtactacgcctcctggtaccagcagaaaccgggccaggcccccgtcctcgtgatctacggaaagaacaacaggccttcgggtatcccagaccggttcagcggcagctccagcggaaacaccgcaagcctcactattaccggggcccaggctgaggacgaggccgactactaccggaactcccgcgactcctcgggcaatccgtacgtctttggtactgggaccaaggtcaccgtgctgggatcgcaccaccatcaccatcatcatcac

SEQ ID NO: 343 - protein, 278 aa, Artificial Sequence
  Description of Artificial Sequence: Synthetic polypeptide
MALPVTALLLPLALLLHAARPEVQLVESGGGLVQPGGSLRLSCAASGFTFSSYAMSWVRQAPGKGLEWVSYISSSSSTIYYADSVKGRFTISRDNAKNSLYLQMNSLRAEDTAVYYCARDGPIRYFDHSKAFDIWGQGTMVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYRNSRDSSGNPYVFGTGTKVTVLGSHHHHHHHH

SEQ ID NO: 344 - protein, 491 aa, Artificial Sequence
  Description of Artificial Sequence: Synthetic polypeptide
MALPVTALLLPLALLLHAARPEVQLVESGGGLVQPGGSLRLSCAASGFTFSSYAMSWVRQAPGKGLEWVSYISSSSSTIYYADSVKGRFTISRDNAKNSLYLQMNSLRAEDTAVYYCARDGPIRYFDHSKAFDIWGQGTMVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYRNSRDSSGNPYVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 345 - DNA, 1473 bp, Artificial Sequence
  Description of Artificial Sequence: Synthetic polynucleotide
atggccctccctgtcaccgccctgctgcttccgctggctcttctgctccacgccgctcggcccgaagtgcaattggtggaatcaggaggaggacttgtgcaacctggaggatctctgagactgtcatgcgccgcgtcgggattcactttctcctcctacgcaatgtcgtgggtcagacaggcccccggaaagggcctggaatgggtgtcatacatcagctcctcctcctccacgatctactacgccgactctgtgaaggggcggttcaccattagccgggacaacgcaaagaactccctgtatctgcaaatgaacagcctcagggcggaagataccgccgtgtactactgtgcgcgcgatggtccgattcgctatttcgaccactccaaggccttcgatatctggggccagggaaccatggtcaccgtgtcgtccggtggaggcggcagcggggggggcggaagcggcggcgggggttcatcctcggagctgactcaggaccccgccgtgtccgtggctctgggacagaccgtgcgcatcacatgccagggagattccctgcggtcgtactacgcctcctggtaccagcagaaaccgggccaggcccccgtcctcgtgatctacggaaagaacaacaggccttcgggtatcccagaccggttcagcggcagctccagcggaaacaccgcaagcctcactattaccggggcccaggctgaggacgaggccgactactaccggaactcccgcgactcctcgggcaatccgtacgtctttggtactgggaccaaggtcaccgtgctgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 346 - protein, 244 aa, Artificial Sequence
  Description of Artificial Sequence: Synthetic polypeptide
QVQLVQSGAEVKKPGASVKVSCKASGYTFTSYYMHWVRQAPGQGLEWMGIINPSGGSTSYAQKFQGRVTMTRDTSISTAYMELSRLRSDDTAVYYCAREMDDSSGPDYWGQGTLVTVSSGGGGSGGGGSGGGGSQSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLVFGTGTKLTVL

SEQ ID NO: 347 - DNA, 732 bp, Artificial Sequence
  Description of Artificial Sequence: Synthetic polynucleotide
caagtgcagctcgtccagtccggtgcagaagtcaagaaacccggtgcttccgtgaaagtgtcctgcaaggcatccggctacacgttcacctcctactacatgcattgggtccgccaagcccccggccaaggcctggagtggatggggatcattaacccaagcggaggaagcactagctacgcgcagaagtttcagggccgcgtgaccatgaccagggatacttccatctccaccgcttacatggaactgtcgcggctgagaagcgacgacacagccgtgtactactgtgcccgggaaatggacgactcctccgggcctgattactggggacaggggactctggtcaccgtgtcgtccggtggaggcggatcggggggcggaggttccggcggagggggctcacagtccgcgctgacccagccggccagcgtgtcaggatcaccgggccagagcatcaccatttcctgcaccggaacctcatcggacgtcggcggatataactacgtgtcgtggtaccagcagcaccctggaaaggccccgaagctcatgatctacgaggtgtccaatagacccagcggagtgtcgaaccggttcagcgggtccaagtcgggaaacaccgccagcttgaccatctctggactgcaagccgaggacgaagccgattactactgctcctcgtatacttcctcctcaacccttgtgttcggaactggcactaagctgaccgtgctc

SEQ ID NO: 348 - DNA, 825 bp, Artificial Sequence
  Description of Artificial Sequence: Synthetic polynucleotide
atggccctccctgtcaccgccctgctgcttccgctggctcttctgctccacgccgctcggccccaagtgcagctcgtccagtccggtgcagaagtcaagaaacccggtgcttccgtgaaagtgtcctgcaaggcatccggctacacgttcacctcctactacatgcattgggtccgccaagcccccggccaaggcctggagtggatggggatcattaacccaagcggaggaagcactagctacgcgcagaagtttcagggccgcgtgaccatgaccagggatacttccatctccaccgcttacatggaactgtcgcggctgagaagcgacgacacagccgtgtactactgtgcccgggaaatggacgactcctccgggcctgattactggggacaggggactctggtcaccgtgtcgtccggtggaggcggatcggggggcggaggttccggcggagggggctcacagtccgcgctgacccagccggccagcgtgtcaggatcaccgggccagagcatcaccatttcctgcaccggaacctcatcggacgtcggcggatataactacgtgtcgtggtaccagcagcaccctggaaaggccccgaagctcatgatctacgaggtgtccaatagacccagcggagtgtcgaaccggttcagcgggtccaagtcgggaaacaccgccagcttgaccatctctggactgcaagccgaggacgaagccgattactactgctcctcgtatacttcctcctcaacccttgtgttcggaactggcactaagctgaccgtgctcggatcgcaccaccatcaccatcatcatcac

SEQ ID NO: 349 - protein, 275 aa, Artificial Sequence
  Description of Artificial Sequence: Synthetic polypeptide
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSISTAYMELSRLRSDDTAVYYCAREMDDSSGPDYWGQGTLVTVSSGGGGSGGGGSGGGGSQSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLVFGTGTKLTVLGSHHHHHHHH

SEQ ID NO: 350 - protein, 488 aa, Artificial Sequence
  Description of Artificial Sequence: Synthetic polypeptide
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSISTAYMELSRLRSDDTAVYYCAREMDDSSGPDYWGQGTLVTVSSGGGGSGGGGSGGGGSQSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLVFGTGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 351 - DNA, 1464 bp, Artificial Sequence
  Description of Artificial Sequence: Synthetic polynucleotide
atggccctccctgtcaccgccctgctgcttccgctggctcttctgctccacgccgctcggccccaagtgcagctcgtccagtccggtgcagaagtcaagaaacccggtgcttccgtgaaagtgtcctgcaaggcatccggctacacgttcacctcctactacatgcattgggtccgccaagcccccggccaaggcctggagtggatggggatcattaacccaagcggaggaagcactagctacgcgcagaagtttcagggccgcgtgaccatgaccagggatacttccatctccaccgcttacatggaactgtcgcggctgagaagcgacgacacagccgtgtactactgtgcccgggaaatggacgactcctccgggcctgattactggggacaggggactctggtcaccgtgtcgtccggtggaggcggatcggggggcggaggttccggcggagggggctcacagtccgcgctgacccagccggccagcgtgtcaggatcaccgggccagagcatcaccatttcctgcaccggaacctcatcggacgtcggcggatataactacgtgtcgtggtaccagcagcaccctggaaaggccccgaagctcatgatctacgaggtgtccaatagacccagcggagtgtcgaaccggttcagcgggtccaagtcgggaaacaccgccagcttgaccatctctggactgcaagccgaggacgaagccgattactactgctcctcgtatacttcctcctcaacccttgtgttcggaactggcactaagctgaccgtgctcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 352 - protein, 252 aa, Artificial Sequence
  Description of Artificial Sequence: Synthetic polypeptide
EVQLVESGAEVKKPGESLKISCKGSGYSFTGSWIGWGRQMPGKGLEWMGIIYPGDSDTRYSPSFQGQVTISADKSISTAYLQWSSLKASDTAMYYCARGFLRGGDCCGALDIWGQGTMVTVSSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPPWTFGQGTKLEIKR

SEQ ID NO: 353 - DNA, 756 bp, Artificial Sequence
  Description of Artificial Sequence: Synthetic polynucleotide
gaagtgcagttggtggaatcaggagcagaagtcaagaaacccggagaaagcctgaagatctcgtgcaaagggagcggatactcgttcaccggatcatggattggatggggccgccagatgcctggaaagggtctggaatggatgggaatcatctacccgggggactccgatactcggtactccccgagctttcagggccaggtcaccatctccgccgacaagtccatctccactgcgtatttgcagtggagctcactgaaggcctcggacaccgctatgtactactgcgcccgcggtttcctgaggggcggagattgttgcggcgcccttgatatctggggccaggggaccatggtgaccgtgtcctccggtggtggcggctccggcggaggagggtccgggggaggaggctccgacattgtgatgacccagagccccctgtccctgcccgtgactcctggggagccagcctcgatcagctgccggtcgtcccagtcccttctgcactccaacggctacaactatctcgattggtacctccagaagcctggtcaaagcccgcagctgctgatctacctcggttcaaacagagcttccggggtgccggacagattcagcggatctggatcgggcacagacttcacgctcaagatttcccgcgtggaggccgaggacgtcggcgtgtactactgtatgcaagcgctgcagaccccgccctggactttcggacaaggaaccaagctggagattaagcgg

SEQ ID NO: 354 - DNA, 849 bp, Artificial Sequence
  Description of Artificial Sequence: Synthetic polynucleotide
atggccctccctgtcaccgccctgctgcttccgctggctcttctgctccacgccgctcggcccgaagtgcagttggtggaatcaggagcagaagtcaagaaacccggagaaagcctgaagatctcgtgcaaagggagcggatactcgttcaccggatcatggattggatggggccgccagatgcctggaaagggtctggaatggatgggaatcatctacccgggggactccgatactcggtactccccgagctttcagggccaggtcaccatctccgccgacaagtccatctccactgcgtatttgcagtggagctcactgaaggcctcggacaccgctatgtactactgcgcccgcggtttcctgaggggcggagattgttgcggcgcccttgatatctggggccaggggaccatggtgaccgtgtcctccggtggtggcggctccggcggaggagggtccgggggaggaggctccgacattgtgatgacccagagccccctgtccctgcccgtgactcctggggagccagcctcgatcagctgccggtcgtcccagtcccttctgcactccaacggctacaactatctcgattggtacctccagaagcctggtcaaagcccgcagctgctgatctacctcggttcaaacagagcttccggggtgccggacagattcagcggatctggatcgggcacagacttcacgctcaagatttcccgcgtggaggccgaggacgtcggcgtgtactactgtatgcaagcgctgcagaccccgccctggactttcggacaaggaaccaagctggagattaagcggggatcgcaccaccatcaccatcatcatcac

SEQ ID NO: 355 - protein, 283 aa, Artificial Sequence
  Description of Artificial Sequence: Synthetic polypeptide
MALPVTALLLPLALLLHAARPEVQLVESGAEVKKPGESLKISCKGSGYSFTGSWIGWGRQMPGKGLEWMGIIYPGDSDTRYSPSFQGQVTISADKSISTAYLQWSSLKASDTAMYYCARGFLRGGDCCGALDIWGQGTMVTVSSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPPWTFGQGTKLEIKRGSHHHHHHHH

SEQ ID NO: 356 - protein, 496 aa, Artificial Sequence
  Description of Artificial Sequence: Synthetic polypeptide
MALPVTALLLPLALLLHAARPEVQLVESGAEVKKPGESLKISCKGSGYSFTGSWIGWGRQMPGKGLEWMGIIYPGDSDTRYSPSFQGQVTISADKSISTAYLQWSSLKASDTAMYYCARGFLRGGDCCGALDIWGQGTMVTVSSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPPWTFGQGTKLEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 357 - DNA, 1488 bp, Artificial Sequence
  Description of Artificial Sequence: Synthetic polynucleotide
atggccctccctgtcaccgccctgctgcttccgctggctcttctgctccacgccgctcggcccgaagtgcagttggtggaatcaggagcagaagtcaagaaacccggagaaagcctgaagatctcgtgcaaagggagcggatactcgttcaccggatcatggattggatggggccgccagatgcctggaaagggtctggaatggatgggaatcatctacccgggggactccgatactcggtactccccgagctttcagggccaggtcaccatctccgccgacaagtccatctccactgcgtatttgcagtggagctcactgaaggcctcggacaccgctatgtactactgcgcccgcggtttcctgaggggcggagattgttgcggcgcccttgatatctggggccaggggaccatggtgaccgtgtcctccggtggtggcggctccggcggaggagggtccgggggaggaggctccgacattgtgatgacccagagccccctgtccctgcccgtgactcctggggagccagcctcgatcagctgccggtcgtcccagtcccttctgcactccaacggctacaactatctcgattggtacctccagaagcctggtcaaagcccgcagctgctgatctacctcggttcaaacagagcttccggggtgccggacagattcagcggatctggatcgggcacagacttcacgctcaagatttcccgcgtggaggccgaggacgtcggcgtgtactactgtatgcaagcgctgcagaccccgccctggactttcggacaaggaaccaagctggagattaagcggaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 358 - protein, 250 aa, Artificial Sequence
  Description of Artificial Sequence: Synthetic polypeptide
QVQLQESGPGLVKPSETLSLTCSVSGGSINSYYWSWIRQAPGKGLEWIAFTSHSGNVKYNPSLTGRVTIAVDTSKNQFYLEVTSVTAADTAVYFCARGLDPLFAYDAFEIWGLGTMVTVSSGGGGSGGGGSGGGGSEIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQVLQTPPLTFGGGTKVDIKR

SEQ ID NO: 359 - DNA, 750 bp, Artificial Sequence
  Description of Artificial Sequence: Synthetic polynucleotide
caagtgcaacttcaggaatcaggccccggacttgtgaaaccatcagaaactctctccctcacttgctccgtgagcggggggtccatcaactcctactactggtcgtggattagacaggcccctggaaaggggctggagtggatcgcgttcacttcgcactccggcaacgtcaagtacaacccgtccctgaccggaagagtgaccattgccgtggatacctccaagaaccagttctacctggaagtcacgtcggtgaccgctgctgacaccgccgtgtacttctgcgcacgggggctggacccattgtttgcctacgatgcgttcgaaatctgggggctcggaaccatggtcactgtgtcctccggcggaggcggcagcggtggaggaggcagcggaggaggaggttccgagatcgtgctgacccagagccccctgtccctccccgtgacccctggagaaccggccagcatttcctgccggtcgagccagtccctgttgcattcaaatggctacaactacctggattggtatctgcagaagcccggccagtcaccgcaactgctcatctacctgggaagcaaccgcgcctcgggtgtcccggaccgcttctccggctcggggtctggcactgacttcacactgaagatctccagggtggaggccgaggacgtgggagtgtattactgtatgcaagtgctgcagaccccgcctctgaccttcggcggtggaactaaggtcgacatcaagcgg

SEQ ID NO: 360 - DNA, 843 bp, Artificial Sequence
  Description of Artificial Sequence: Synthetic polynucleotide
atggccctccctgtcaccgccctgctgcttccgctggctcttctgctccacgccgctcggccccaagtgcaacttcaggaatcaggccccggacttgtgaaaccatcagaaactctctccctcacttgctccgtgagcggggggtccatcaactcctactactggtcgtggattagacaggcccctggaaaggggctggagtggatcgcgttcacttcgcactccggcaacgtcaagtacaacccgtccctgaccggaagagtgaccattgccgtggatacctccaagaaccagttctacctggaagtcacgtcggtgaccgctgctgacaccgccgtgtacttctgcgcacgggggctggacccattgtttgcctacgatgcgttcgaaatctgggggctcggaaccatggtcactgtgtcctccggcggaggcggcagcggtggaggaggcagcggaggaggaggttccgagatcgtgctgacccagagccccctgtccctccccgtgacccctggagaaccggccagcatttcctgccggtcgagccagtccctgttgcattcaaatggctacaactacctggattggtatctgcagaagcccggccagtcaccgcaactgctcatctacctgggaagcaaccgcgcctcgggtgtcccggaccgcttctccggctcggggtctggcactgacttcacactgaagatctccagggtggaggccgaggacgtgggagtgtattactgtatgcaagtgctgcagaccccgcctctgaccttcggcggtggaactaaggtcgacatcaagcggggatcgcaccaccatcaccatcatcatcac

SEQ ID NO: 361 - protein, 281 aa, Artificial Sequence
  Description of Artificial Sequence: Synthetic polypeptide
MALPVTALLLPLALLLHAARPQVQLQESGPGLVKPSETLSLTCSVSGGSINSYYWSWIRQAPGKGLEWIAFTSHSGNVKYNPSLTGRVTIAVDTSKNQFYLEVTSVTAADTAVYFCARGLDPLFAYDAFEIWGLGTMVTVSSGGGGSGGGGSGGGGSEIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQVLQTPPLTFGGGTKVDIKRGSHHHHHHHH

SEQ ID NO: 362 - protein, 494 aa, Artificial Sequence
  Description of Artificial Sequence: Synthetic polypeptide
MALPVTALLLPLALLLHAARPQVQLQESGPGLVKPSETLSLTCSVSGGSINSYYWSWIRQAPGKGLEWIAFTSHSGNVKYNPSLTGRVTIAVDTSKNQFYLEVTSVTAADTAVYFCARGLDPLFAYDAFEIWGLGTMVTVSSGGGGSGGGGSGGGGSEIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQVLQTPPLTFGGGTKVDIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 363 - DNA, 1482 bp, Artificial Sequence
  Description of Artificial Sequence: Synthetic polynucleotide
atggccctccctgtcaccgccctgctgcttccgctggctcttctgctccacgccgctcggccccaagtgcaacttcaggaatcaggccccggacttgtgaaaccatcagaaactctctccctcacttgctccgtgagcggggggtccatcaactcctactactggtcgtggattagacaggcccctggaaaggggctggagtggatcgcgttcacttcgcactccggcaacgtcaagtacaacccgtccctgaccggaagagtgaccattgccgtggatacctccaagaaccagttctacctggaagtcacgtcggtgaccgctgctgacaccgccgtgtacttctgcgcacgggggctggacccattgtttgcctacgatgcgttcgaaatctgggggctcggaaccatggtcactgtgtcctccggcggaggcggcagcggtggaggaggcagcggaggaggaggttccgagatcgtgctgacccagagccccctgtccctccccgtgacccctggagaaccggccagcatttcctgccggtcgagccagtccctgttgcattcaaatggctacaactacctggattggtatctgcagaagcccggccagtcaccgcaactgctcatctacctgggaagcaaccgcgcctcgggtgtcccggaccgcttctccggctcggggtctggcactgacttcacactgaagatctccagggtggaggccgaggacgtgggagtgtattactgtatgcaagtgctgcagaccccgcctctgaccttcggcggtggaactaaggtcgacatcaagcggaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 364 - protein, 247 aa, Artificial Sequence
  Description of Artificial Sequence: Synthetic polypeptide
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDDFWSGSVDYWGQGTLVTVSSGGGGSGGGGSGGGGSGGGGSSYVLTQPPSVSVAPGKTATITCGGTNIGSKNVHWYQQKPGQAPVLAIYYDSDRPSGIPERFSGSNSGNTATLTISRVEAGDEADYFCQVWDSSSDHWVFGGGTKLTVL

SEQ ID NO: 365 - DNA, 741 bp, Artificial Sequence
  Description of Artificial Sequence: Synthetic polynucleotide
gaagtgcagttggtggaatctggtggtggactcgtgaaacctggaggaagcttgcgcctgtcttgcgcggcctccggcttcactttctcggattactacatgtcctggattagacaggctccggggaagggactcgaatgggtgtcctacatttcatcaagcggcagcaccatctactatgcggactccgtgaaggggcggttcactatttcccgggataacgcaaagaacagcctgtaccttcaaatgaattcactgcgcgccgaggacaccgccgtgtactattgcgcccgggatgacttctggtcggggtccgtggactactggggccaggggaccctggtcaccgtgtcctcgggaggaggaggaagcgggggaggcggttccgggggcggcggctcgggcggcggtggctccagctacgtgctcacccagccgccctccgtgtccgtggccccgggaaagaccgccaccatcacctgtggaggaacgaacatcggctccaagaacgtccattggtaccagcagaagcccggacaggcccccgtgctggcaatctactacgactccgaccgcccaagcggtatccctgaaaggttctccggctccaacagcggaaacactgcgactctgaccatctcaagagtggaggctggcgatgaggccgactacttctgccaagtctgggactcgtcctcggaccactgggtgtttgggggaggcaccaagctgactgtcctg

SEQ ID NO: 366 - DNA, 834 bp, Artificial Sequence
  Description of Artificial Sequence: Synthetic polynucleotide
atggccctccctgtcaccgccctgctgcttccgctggctcttctgctccacgccgctcggcccgaagtgcagttggtggaatctggtggtggactcgtgaaacctggaggaagcttgcgcctgtcttgcgcggcctccggcttcactttctcggattactacatgtcctggattagacaggctccggggaagggactcgaatgggtgtcctacatttcatcaagcggcagcaccatctactatgcggactccgtgaaggggcggttcactatttcccgggataacgcaaagaacagcctgtaccttcaaatgaattcactgcgcgccgaggacaccgccgtgtactattgcgcccgggatgacttctggtcggggtccgtggactactggggccaggggaccctggtcaccgtgtcctcgggaggaggaggaagcgggggaggcggttccgggggcggcggctcgggcggcggtggctccagctacgtgctcacccagccgccctccgtgtccgtggccccgggaaagaccgccaccatcacctgtggaggaacgaacatcggctccaagaacgtccattggtaccagcagaagcccggacaggcccccgtgctggcaatctactacgactccgaccgcccaagcggtatccctgaaaggttctccggctccaacagcggaaacactgcgactctgaccatctcaagagtggaggctggcgatgaggccgactacttctgccaagtctgggactcgtcctcggaccactgggtgtttgggggaggcaccaagctgactgtcctgggatcgcaccaccatcaccatcatcatcac

SEQ ID NO: 367 - protein, 278 aa, Artificial Sequence
  Description of Artificial Sequence: Synthetic polypeptide
MALPVTALLLPLALLLHAARPEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDDFWSGSVDYWGQGTLVTVSSGGGGSGGGGSGGGGSGGGGSSYVLTQPPSVSVAPGKTATITCGGTNIGSKNVHWYQQKPGQAPVLAIYYDSDRPSGIPERFSGSNSGNTATLTISRVEAGDEADYFCQVWDSSSDHWVFGGGTKLTVLGSHHHHHHHH

SEQ ID NO: 368 - protein, 491 aa, Artificial Sequence
  Description of Artificial Sequence: Synthetic polypeptide
MALPVTALLLPLALLLHAARPEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDDFWSGSVDYWGQGTLVTVSSGGGGSGGGGSGGGGSGGGGSSYVLTQPPSVSVAPGKTATITCGGTNIGSKNVHWYQQKPGQAPVLAIYYDSDRPSGIPERFSGSNSGNTATLTISRVEAGDEADYFCQVWDSSSDHWVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 369 - DNA, 1473 bp, Artificial Sequence
  Description of Artificial Sequence: Synthetic polynucleotide
atggccctccctgtcaccgccctgctgcttccgctggctcttctgctccacgccgctcggcccgaagtgcagttggtggaatctggtggtggactcgtgaaacctggaggaagcttgcgcctgtcttgcgcggcctccggcttcactttctcggattactacatgtcctggattagacaggctccggggaagggactcgaatgggtgtcctacatttcatcaagcggcagcaccatctactatgcggactccgtgaaggggcggttcactatttcccgggataacgcaaagaacagcctgtaccttcaaatgaattcactgcgcgccgaggacaccgccgtgtactattgcgcccgggatgacttctggtcggggtccgtggactactggggccaggggaccctggtcaccgtgtcctcgggaggaggaggaagcgggggaggcggttccgggggcggcggctcgggcggcggtggctccagctacgtgctcacccagccgccctccgtgtccgtggccccgggaaagaccgccaccatcacctgtggaggaacgaacatcggctccaagaacgtccattggtaccagcagaagcccggacaggcccccgtgctggcaatctactacgactccgaccgcccaagcggtatccctgaaaggttctccggctccaacagcggaaacactgcgactctgaccatctcaagagtggaggctggcgatgaggccgactacttctgccaagtctgggactcgtcctcggaccactgggtgtttgggggaggcaccaagctgactgtcctgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 370 - protein, 250 aa, Artificial Sequence
  Description of Artificial Sequence: Synthetic polypeptide
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREDDSSGYTSPFDYWGQGTLVTVSSGGGGSGGGGSGGGGSGGGRSSYELTQPPSVSVAPGETASIACGGHNIRSKNVHWYQQKPGQAPVLVISYDGDRPSGIPERFSGSNLGSTATLTISRVEAGDEADYYCQVWDSDSDHYVFGTGTKVTVL

SEQ ID NO: 371 - DNA, 750 bp, Artificial Sequence
  Description of Artificial Sequence: Synthetic polynucleotide
caagtccaactcgtccagtccggtgcagaagtcaagaaacccggagcttccgtgaaagtgtcctgcaaggcctcggggtacacattcacctcctactacatgcactgggtgcgccaggccccgggccagggactggaatggatgggaatcattaacccgtccggcggatcgaccagctacgcccagaagtttcagggacgcgtgaccatgacccgggacactagcaccagcactgtgtacatggaactgagctcactgcggtccgaggacactgcggtgtactattgcgcccgggaggacgattcctccgggtacacttcgcccttcgactattggggacagggaaccttggtcaccgtgtcatcgggtggtggaggaagcggaggaggcggctccggcggcgggggttcaggcggtggcagaagctcctacgaactgacccagcctccgtccgtgtccgtggcccccggcgaaaccgcctcgatcgcgtgtggagggcacaatattcggagcaagaacgtgcattggtaccagcagaagccgggacaggcaccagtgctcgtgatctcctacgatggggacaggccttctggcatccctgagagattcagcgggtccaacctgggctccactgctaccctgaccatctcgcgcgtggaagccggggatgaggccgactactactgccaagtctgggactccgacagcgatcactacgtgttcggaactggaaccaaggtcacggtgctt

SEQ ID NO: 372 - DNA, 843 bp, Artificial Sequence
  Description of Artificial Sequence: Synthetic polynucleotide
atggccctccctgtcaccgccctgctgcttccgctggctcttctgctccacgccgctcggccccaagtccaactcgtccagtccggtgcagaagtcaagaaacccggagcttccgtgaaagtgtcctgcaaggcctcggggtacacattcacctcctactacatgcactgggtgcgccaggccccgggccagggactggaatggatgggaatcattaacccgtccggcggatcgaccagctacgcccagaagtttcagggacgcgtgaccatgacccgggacactagcaccagcactgtgtacatggaactgagctcactgcggtccgaggacactgcggtgtactattgcgcccgggaggacgattcctccgggtacacttcgcccttcgactattggggacagggaaccttggtcaccgtgtcatcgggtggtggaggaagcggaggaggcggctccggcggcgggggttcaggcggtggcagaagctcctacgaactgacccagcctccgtccgtgtccgtggcccccggcgaaaccgcctcgatcgcgtgtggagggcacaatattcggagcaagaacgtgcattggtaccagcagaagccgggacaggcaccagtgctcgtgatctcctacgatggggacaggccttctggcatccctgagagattcagcgggtccaacctgggctccactgctaccctgaccatctcgcgcgtggaagccggggatgaggccgactactactgccaagtctgggactccgacagcgatcactacgtgttcggaactggaaccaaggtcacggtgcttggatcgcaccaccatcaccatcatcatcac

SEQ ID NO: 373 - protein, 281 aa, Artificial Sequence
  Description of Artificial Sequence: Synthetic polypeptide
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREDDSSGYTSPFDYWGQGTLVTVSSGGGGSGGGGSGGGGSGGGRSSYELTQPPSVSVAPGETASIACGGHNIRSKNVHWYQQKPGQAPVLVISYDGDRPSGIPERFSGSNLGSTATLTISRVEAGDEADYYCQVWDSDSDHYVFGTGTKVTVLGSHHHHHHHH

SEQ ID NO: 374 - protein, 494 aa, Artificial Sequence
  Description of Artificial Sequence: Synthetic polypeptide
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREDDSSGYTSPFDYWGQGTLVTVSSGGGGSGGGGSGGGGSGGGRSSYELTQPPSVSVAPGETASIACGGHNIRSKNVHWYQQKPGQAPVLVISYDGDRPSGIPERFSGSNLGSTATLTISRVEAGDEADYYCQVWDSDSDHYVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 375 - DNA, 1482 bp, Artificial Sequence
  Description of Artificial Sequence: Synthetic polynucleotide
atggccctccctgtcaccgccctgctgcttccgctggctcttctgctccacgccgctcggccccaagtccaactcgtccagtccggtgcagaagtcaagaaacccggagcttccgtgaaagtgtcctgcaaggcctcggggtacacattcacctcctactacatgcactgggtgcgccaggccccgggccagggactggaatggatgggaatcattaacccgtccggcggatcgaccagctacgcccagaagtttcagggacgcgtgaccatgacccgggacactagcaccagcactgtgtacatggaactgagctcactgcggtccgaggacactgcggtgtactattgcgcccgggaggacgattcctccgggtacacttcgcccttcgactattggggacagggaaccttggtcaccgtgtcatcgggtggtggaggaagcggaggaggcggctccggcggcgggggttcaggcggtggcagaagctcctacgaactgacccagcctccgtccgtgtccgtggcccccggcgaaaccgcctcgatcgcgtgtggagggcacaatattcggagcaagaacgtgcattggtaccagcagaagccgggacaggcaccagtgctcgtgatctcctacgatggggacaggccttctggcatccctgagagattcagcgggtccaacctgggctccactgctaccctgaccatctcgcgcgtggaagccggggatgaggccgactactactgccaagtctgggactccgacagcgatcactacgtgttcggaactggaaccaaggtcacggtgcttaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 376 - protein, 252 aa, Artificial Sequence
  Description of Artificial Sequence: Synthetic polypeptide
EVQLVESGAEVKKPGASVKVSCKASGYTFTGYYMHWVRQAPGQGLEWMGWINPNSGGTNYAQKFQGRVTMTRDTSISTAYMELSRLRSDDTAVYYCAREPASSSWYGYYYYMDVWGKGTLVTVSSGGGGSGGGGSGGGGSGGGGSDIQMTQSPSSLSASVGDRVTITCRASQSINTYLNWYQQKPGKPPKLLIYAASNLQSGVPSRFSGSGSGTHFTLTISSLQPDDFATYYCQQSYSSLLTFGGGTKLEIK

SEQ ID NO: 377 - DNA, 756 bp, Artificial Sequence
  Description of Artificial Sequence: Synthetic polynucleotide
gaagtgcagttggtggaatcaggagcagaagtcaagaaacccggagcatcagtcaaagtgtcctgcaaggcctccgggtacactttcactggttactacatgcattgggtgcgccaggcgcccggacaaggactcgagtggatgggctggattaaccccaactccggcggaaccaactacgcccagaagttccagggtagagtgacgatgactcgggacaccagcatctccaccgcgtacatggagctgtcgagactgaggtccgacgataccgccgtgtactactgcgcccgggaaccggcttcctcgtcttggtacggatattactattacatggatgtctggggaaagggaacacttgtcactgtgtccagcggtggcggaggcagcggcggtggagggtccggcggcggcggatcgggagggggaggcagcgacatccagatgactcagtccccatcctcgctgtcggctagcgtgggcgaccgcgtgaccattacctgtcgggccagccaatccatcaacacctacctgaactggtaccagcagaagccggggaagcctccaaagctgctcatctacgcggcctcaaatctgcaatccggggtgccttcccggttctccggttccggttcggggacccacttcactctgaccattagctcactgcaaccggacgactttgccacctactactgccagcagagctactcctccctcctgaccttcggcggaggaaccaagctcgagatcaag

SEQ ID NO: 378 - DNA, 849 bp, Artificial Sequence
  Description of Artificial Sequence: Synthetic polynucleotide
atggccctccctgtcaccgccctgctgcttccgctggctcttctgctccacgccgctcggcccgaagtgcagttggtggaatcaggagcagaagtcaagaaacccggagcatcagtcaaagtgtcctgcaaggcctccgggtacactttcactggttactacatgcattgggtgcgccaggcgcccggacaaggactcgagtggatgggctggattaaccccaactccggcggaaccaactacgcccagaagttccagggtagagtgacgatgactcgggacaccagcatctccaccgcgtacatggagctgtcgagactgaggtccgacgataccgccgtgtactactgcgcccgggaaccggcttcctcgtcttggtacggatattactattacatggatgtctggggaaagggaacacttgtcactgtgtccagcggtggcggaggcagcggcggtggagggtccggcggcggcggatcgggagggggaggcagcgacatccagatgactcagtccccatcctcgctgtcggctagcgtgggcgaccgcgtgaccattacctgtcgggccagccaatccatcaacacctacctgaactggtaccagcagaagccggggaagcctccaaagctgctcatctacgcggcctcaaatctgcaatccggggtgccttcccggttctccggttccggttcggggacccacttcactctgaccattagctcactgcaaccggacgactttgccacctactactgccagcagagctactcctccctcctgaccttcggcggaggaaccaagctcgagatcaagggatcgcaccaccatcaccatcatcatcac

SEQ ID NO: 379 - protein, 283 aa, Artificial Sequence
  Description of Artificial Sequence: Synthetic polypeptide
MALPVTALLLPLALLLHAARPEVQLVESGAEVKKPGASVKVSCKASGYTFTGYYMHWVRQAPGQGLEWMGWINPNSGGTNYAQKFQGRVTMTRDTSISTAYMELSRLRSDDTAVYYCAREPASSSWYGYYYYMDVWGKGTLVTVSSGGGGSGGGGSGGGGSGGGGSDIQMTQSPSSLSASVGDRVTITCRASQSINTYLNWYQQKPGKPPKLLIYAASNLQSGVPSRFSGSGSGTHFTLTISSLQPDDFATYYCQQSYSSLLTFGGGTKLEIKGSHHHHHHHH

SEQ ID NO: 380 - protein, 496 aa, Artificial Sequence
  Description of Artificial Sequence: Synthetic polypeptide
MALPVTALLLPLALLLHAARPEVQLVESGAEVKKPGASVKVSCKASGYTFTGYYMHWVRQAPGQGLEWMGWINPNSGGTNYAQKFQGRVTMTRDTSISTAYMELSRLRSDDTAVYYCAREPASSSWYGYYYYMDVWGKGTLVTVSSGGGGSGGGGSGGGGSGGGGSDIQMTQSPSSLSASVGDRVTITCRASQSINTYLNWYQQKPGKPPKLLIYAASNLQSGVPSRFSGSGSGTHFTLTISSLQPDDFATYYCQQSYSSLLTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 381 - DNA, 1488 bp, Artificial Sequence
  Description of Artificial Sequence: Synthetic polynucleotide
atggccctccctgtcaccgccctgctgcttccgctggctcttctgctccacgccgctcggcccgaagtgcagttggtggaatcaggagcagaagtcaagaaacccggagcatcagtcaaagtgtcctgcaaggcctccgggtacactttcactggttactacatgcattgggtgcgccaggcgcccggacaaggactcgagtggatgggctggattaaccccaactccggcggaaccaactacgcccagaagttccagggtagagtgacgatgactcgggacaccagcatctccaccgcgtacatggagctgtcgagactgaggtccgacgataccgccgtgtactactgcgcccgggaaccggcttcctcgtcttggtacggatattactattacatggatgtctggggaaagggaacacttgtcactgtgtccagcggtggcggaggcagcggcggtggagggtccggcggcggcggatcgggagggggaggcagcgacatccagatgactcagtccccatcctcgctgtcggctagcgtgggcgaccgcgtgaccattacctgtcgggccagccaatccatcaacacctacctgaactggtaccagcagaagccggggaagcctccaaagctgctcatctacgcggcctcaaatctgcaatccggggtgccttcccggttctccggttccggttcggggacccacttcactctgaccattagctcactgcaaccggacgactttgccacctactactgccagcagagctactcctccctcctgaccttcggcggaggaaccaagctcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 382 - protein, 252 aa, Artificial Sequence
  Description of Artificial Sequence: Synthetic polypeptide
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGDSNYWSYYGMDVWGQGTLVTVSSGGGGSGGGGSGGGGSGGGGSQSVLTQPRSVSGSPGQSVTISCTGTSSDVGGYNYVSWYQQHPGEAPKLIIYDADKRPSGISNRFSSGKSGNTASLTISGLQVEDEADYYCCSYAGGSTWVFGGGTKVTVL

SEQ ID NO: 383 - DNA, 756 bp, Artificial Sequence
  Description of Artificial Sequence: Synthetic polynucleotide
caagtccaactcgtccagtccggtgcagaagtcaagaaacccggagcttccgtgaaagtgtcctgcaaggcctcgggttacaccttcacctcctacgacattaactgggtgcgccaggccactgggcagggactggaatggatgggctggatgaaccctaactcgggcaacaccggctatgcccagaagtttcagggacgcgtgacgatgacccggaatacctccatctcaaccgcctacatggaactgagcagcctgaggtccgaggatactgcagtgtactactgcgctcggggagactccaactattggtcctactacggaatggacgtgtggggccagggaaccctcgtcactgtgtcgagcgggggaggcggttcagggggcggcggaagcggaggcggagggtccggcggaggaggttctcagagcgtgctgactcaaccgagatccgtgtccgggagcccgggccagtcagtgactatctcgtgcaccgggaccagctccgacgtgggagggtacaactacgtgtcgtggtaccagcagcaccccggagaggcgccaaagttgattatctacgacgccgataagcgcccttcgggaatctccaaccggttctcctccgggaagtccggcaacactgcctccctgaccatcagcggacttcaagtggaggacgaagcggattactactgctgttcatacgccggcggatcgacctgggtgttcggcggtggtaccaaggtcacagtgctg

SEQ ID NO: 384 - DNA, 849 bp, Artificial Sequence
  Description of Artificial Sequence: Synthetic polynucleotide
atggccctccctgtcaccgccctgctgcttccgctggctcttctgctccacgccgctcggccccaagtccaactcgtccagtccggtgcagaagtcaagaaacccggagcttccgtgaaagtgtcctgcaaggcctcgggttacaccttcacctcctacgacattaactgggtgcgccaggccactgggcagggactggaatggatgggctggatgaaccctaactcgggcaacaccggctatgcccagaagtttcagggacgcgtgacgatgacccggaatacctccatctcaaccgcctacatggaactgagcagcctgaggtccgaggatactgcagtgtactactgcgctcggggagactccaactattggtcctactacggaatggacgtgtggggccagggaaccctcgtcactgtgtcgagcgggggaggcggttcagggggcggcggaagcggaggcggagggtccggcggaggaggttctcagagcgtgctgactcaaccgagatccgtgtccgggagcccgggccagtcagtgactatctcgtgcaccgggaccagctccgacgtgggagggtacaactacgtgtcgtggtaccagcagcaccccggagaggcgccaaagttgattatctacgacgccgataagcgcccttcgggaatctccaaccggttctcctccgggaagtccggcaacactgcctccctgaccatcagcggacttcaagtggaggacgaagcggattactactgctgttcatacgccggcggatcgacctgggtgttcggcggtggtaccaaggtcacagtgctgggatcgcaccaccatcaccatcatcatcac

SEQ ID NO: 385 - protein, 283 aa, Artificial Sequence
  Description of Artificial Sequence: Synthetic polypeptide
MALPVTALLLPLALLLHAARPQVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGDSNYWSYYGMDVWGQGTLVTVSSGGGGSGGGGSGGGGSGGGGSQSVLTQPRSVSGSPGQSVTISCTGTSSDVGGYNYVSWYQQHPGEAPKLIIYDADKRPSGISNRFSSGKSGNTASLTISGLQVEDEADYYCCSYAGGSTWVFGGGTKVTVLGSHHHHHHHH

SEQ ID NO: 386 - protein, 496 aa, Artificial Sequence
  Description of Artificial Sequence: Synthetic polypeptide
MALPVTALLLPLALLLHAARPQVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGDSNYWSYYGMDVWGQGTLVTVSSGGGGSGGGGSGGGGSGGGGSQSVLTQPRSVSGSPGQSVTISCTGTSSDVGGYNYVSWYQQHPGEAPKLIIYDADKRPSGISNRFSSGKSGNTASLTISGLQVEDEADYYCCSYAGGSTWVFGGGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 387 - DNA, 1488 bp, Artificial Sequence
  Description of Artificial Sequence: Synthetic polynucleotide
atggccctccctgtcaccgccctgctgcttccgctggctcttctgctccacgccgctcggccccaagtccaactcgtccagtccggtgcagaagtcaagaaacccggagcttccgtgaaagtgtcctgcaaggcctcgggttacaccttcacctcctacgacattaactgggtgcgccaggccactgggcagggactggaatggatgggctggatgaaccctaactcgggcaacaccggctatgcccagaagtttcagggacgcgtgacgatgacccggaatacctccatctcaaccgcctacatggaactgagcagcctgaggtccgaggatactgcagtgtactactgcgctcggggagactccaactattggtcctactacggaatggacgtgtggggccagggaaccctcgtcactgtgtcgagcgggggaggcggttcagggggcggcggaagcggaggcggagggtccggcggaggaggttctcagagcgtgctgactcaaccgagatccgtgtccgggagcccgggccagtcagtgactatctcgtgcaccgggaccagctccgacgtgggagggtacaactacgtgtcgtggtaccagcagcaccccggagaggcgccaaagttgattatctacgacgccgataagcgcccttcgggaatctccaaccggttctcctccgggaagtccggcaacactgcctccctgaccatcagcggacttcaagtggaggacgaagcggattactactgctgttcatacgccggcggatcgacctgggtgttcggcggtggtaccaaggtcacagtgctgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 388 - protein, 247 aa, Artificial Sequence
  Description of Artificial Sequence: Synthetic polypeptide
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCASFSSSDSYDYWGQGTLVTVSSGGGGSGGGGSGGGGSGGGGSEIVLTQSPATLSVSPGERATLSCRASQSVTSNLAWYQQKPGQAPRLLIYAASTRATGIPARFSGSGSGTEFTLTISSMQSEDFAVYFCQQYHTWPPLTFGGGTKVEIKT

SEQ ID NO: 389 - DNA, 741 bp, Artificial Sequence
  Description of Artificial Sequence: Synthetic polynucleotide
caagtccaactcgtccagtccggtgcagaagtcaagaaaccaggagcttcagtgaaagtgtcgtgcaaggcctccgggtataccttcacttcctacggcattagctgggtgcggcaggcccccggccaagggctggagtggatgggctggatcagcgcctacaacggaaacaccaactacgcccagaagctgcagggacgcgtgaccatgaccactgacacctccacttcgaccgcgtacatggagctcagatcactgcgctccgacgataccgccgtgtactactgcgcctccttctcctcctccgactcctacgactactggggacaggggactctggtcactgtgtcgtccggcggcggcggaagcggtggcggaggcagcggtggaggcggttcgggaggaggagggtccgaaatcgtgctgacccagtcccccgctaccctttccgtgagcccgggggaacgggccaccctgtcttgccgcgcgtcacaaagcgtgacttcgaacctggcctggtaccagcagaagccggggcaggccccgagattgctcatctatgccgcgagcaccagggcaaccggaattcctgcccggttttccggttccgggtcgggcactgagttcaccctgacaatcagctcaatgcagtccgaggatttcgctgtgtacttctgtcaacagtaccacacctggcctcccctgacgttcggaggcggaaccaaggtcgaaatcaagacc

SEQ ID NO: 390 - DNA, 834 bp, Artificial Sequence
  Description of Artificial Sequence: Synthetic polynucleotide
atggccctccctgtcaccgccctgctgcttccgctggctcttctgctccacgccgctcggccccaagtccaactcgtccagtccggtgcagaagtcaagaaaccaggagcttcagtgaaagtgtcgtgcaaggcctccgggtataccttcacttcctacggcattagctgggtgcggcaggcccccggccaagggctggagtggatgggctggatcagcgcctacaacggaaacaccaactacgcccagaagctgcagggacgcgtgaccatgaccactgacacctccacttcgaccgcgtacatggagctcagatcactgcgctccgacgataccgccgtgtactactgcgcctccttctcctcctccgactcctacgactactggggacaggggactctggtcactgtgtcgtccggcggcggcggaagcggtggcggaggcagcggtggaggcggttcgggaggaggagggtccgaaatcgtgctgacccagtcccccgctaccctttccgtgagcccgggggaacgggccaccctgtcttgccgcgcgtcacaaagcgtgacttcgaacctggcctggtaccagcagaagccggggcaggccccgagattgctcatctatgccgcgagcaccagggcaaccggaattcctgcccggttttccggttccgggtcgggcactgagttcaccctgacaatcagctcaatgcagtccgaggatttcgctgtgtacttctgtcaacagtaccacacctggcctcccctgacgttcggaggcggaaccaaggtcgaaatcaagaccggatcgcaccaccatcaccatcatcatcac

SEQ ID NO: 391 - protein, 278 aa, Artificial Sequence
  Description of Artificial Sequence: Synthetic polypeptide
MALPVTALLLPLALLLHAARPQVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCASFSSSDSYDYWGQGTLVTVSSGGGGSGGGGSGGGGSGGGGSEIVLTQSPATLSVSPGERATLSCRASQSVTSNLAWYQQKPGQAPRLLIYAASTRATGIPARFSGSGSGTEFTLTISSMQSEDFAVYFCQQYHTWPPLTFGGGTKVEIKTGSHHHHHHHH

SEQ ID NO: 392 - protein, 490 aa, Artificial Sequence
  Description of Artificial Sequence: Synthetic polypeptide
MALPVTALLLPLALLLHAARPQVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCASFSSSDSYDYWGQGTLVTVSSGGGGSGGGGSGGGGSGGGGSEIVLTQSPATLSVSPGERATLSCRASQSVTSNLAWYQQKPGQAPRLLIYAASTRATGIPARFSGSGSGTEFTLTISSMQSEDFAVYFCQQYHTWPPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 393 - DNA, 1470 bp, Artificial Sequence
  Description of Artificial Sequence: Synthetic polynucleotide
atggccctccctgtcaccgccctgctgcttccgctggctcttctgctccacgccgctcggccccaagtccaactcgtccagtccggtgcagaagtcaagaaaccaggagcttcagtgaaagtgtcgtgcaaggcctccgggtataccttcacttcctacggcattagctgggtgcggcaggcccccggccaagggctggagtggatgggctggatcagcgcctacaacggaaacaccaactacgcccagaagctgcagggacgcgtgaccatgaccactgacacctccacttcgaccgcgtacatggagctcagatcactgcgctccgacgataccgccgtgtactactgcgcctccttctcctcctccgactcctacgactactggggacaggggactctggtcactgtgtcgtccggcggcggcggaagcggtggcggaggcagcggtggaggcggttcgggaggaggagggtccgaaatcgtgctgacccagtcccccgctaccctttccgtgagcccgggggaacgggccaccctgtcttgccgcgcgtcacaaagcgtgacttcgaacctggcctggtaccagcagaagccggggcaggccccgagattgctcatctatgccgcgagcaccagggcaaccggaattcctgcccggttttccggttccgggtcgggcactgagttcaccctgacaatcagctcaatgcagtccgaggatttcgctgtgtacttctgtcaacagtaccacacctggcctcccctgacgttcggaggcggaaccaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 394 - protein, 254 aa, Artificial Sequence
  Description of Artificial Sequence: Synthetic polypeptide
QVNLRESGPALVKPTQTLTLTCTFSGFSLNTFGMSVSWIRQPPGKALEWLALIDWDDDKYYSTSLRTRLTISKDTAKNQVVLRMTNMDPMDTATYYCARIYGGDRTNTQAPYFFDLWGQGTLVTVSSGGGGSGGGGSGGGGSDVVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKLEIK

SEQ ID NO: 395 - DNA, 762 bp, Artificial Sequence
  Description of Artificial Sequence: Synthetic polynucleotide
caagtcaacctcagagaatcaggtcctgccctcgtcaaacctacccagaccctcaccttgacctgtaccttctccgggttctcgctgaacaccttcgggatgtccgtgagctggattaggcagcccccgggaaaggccctggagtggctggccctgatcgattgggatgacgacaagtactactccacctcactccgcactcgcctgaccatctcaaaggacactgccaagaaccaagtggtgctgcggatgactaacatggacccgatggacaccgccacctattactgcgcccggatctacggaggcgacagaaccaacactcaggccccctacttcttcgatctgtggggacagggcactcttgtgaccgtgtcctcgggcggaggaggctccggtggagggggatcaggaggaggcggcagcgacgtcgtgatgactcaatccccgctgtccttgcctgtgacccctggcgaacccgcgtccattagctgccggagcagccagtccctcctgcactcgaacggatacaactacctggattggtatctgcagaagcccggccagtccccacaactcctgatctacctgggctctaatcgggcatccggggtcccggatcgcttcagcggttcgggctcgggtaccgacttcacgctgaagatttccagggtggaagctgaggacgtgggagtgtactactgcatgcaggcgcttcagactccatggacatttggacaggggaccaagctggagatcaag

SEQ ID NO: 396 - DNA, 855 bp, Artificial Sequence
  Description of Artificial Sequence: Synthetic polynucleotide
atggccctccctgtcaccgccctgctgcttccgctggctcttctgctccacgccgctcggccccaagtcaacctcagagaatcaggtcctgccctcgtcaaacctacccagaccctcaccttgacctgtaccttctccgggttctcgctgaacaccttcgggatgtccgtgagctggattaggcagcccccgggaaaggccctggagtggctggccctgatcgattgggatgacgacaagtactactccacctcactccgcactcgcctgaccatctcaaaggacactgccaagaaccaagtggtgctgcggatgactaacatggacccgatggacaccgccacctattactgcgcccggatctacggaggcgacagaaccaacactcaggccccctacttcttcgatctgtggggacagggcactcttgtgaccgtgtcctcgggcggaggaggctccggtggagggggatcaggaggaggcggcagcgacgtcgtgatgactcaatccccgctgtccttgcctgtgacccctggcgaacccgcgtccattagctgccggagcagccagtccctcctgcactcgaacggatacaactacctggattggtatctgcagaagcccggccagtccccacaactcctgatctacctgggctctaatcgggcatccggggtcccggatcgcttcagcggttcgggctcgggtaccgacttcacgctgaagatttccagggtggaagctgaggacgtgggagtgtactactgcatgcaggcgcttcagactccatggacatttggacaggggaccaagctggagatcaagggatcgcaccaccatcaccatcatcatcac

SEQ ID NO: 397 - protein, 285 aa, Artificial Sequence
  Description of Artificial Sequence: Synthetic polypeptide
MALPVTALLLPLALLLHAARPQVNLRESGPALVKPTQTLTLTCTFSGFSLNTFGMSVSWIRQPPGKALEWLALIDWDDDKYYSTSLRTRLTISKDTAKNQVVLRMTNMDPMDTATYYCARIYGGDRTNTQAPYFFDLWGQGTLVTVSSGGGGSGGGGSGGGGSDVVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKLEIKGSHHHHHHHH

SEQ ID NO: 398 - protein, 498 aa, Artificial Sequence
  Description of Artificial Sequence: Synthetic polypeptide
MALPVTALLLPLALLLHAARPQVNLRESGPALVKPTQTLTLTCTFSGFSLNTFGMSVSWIRQPPGKALEWLALIDWDDDKYYSTSLRTRLTISKDTAKNQVVLRMTNMDPMDTATYYCARIYGGDRTNTQAPYFFDLWGQGTLVTVSSGGGGSGGGGSGGGGSDVVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 399 - DNA, 1494 bp, Artificial Sequence
  Description of Artificial Sequence: Synthetic polynucleotide
atggccctccctgtcaccgccctgctgcttccgctggctcttctgctccacgccgctcggccccaagtcaacctcagagaatcaggtcctgccctcgtcaaacctacccagaccctcaccttgacctgtaccttctccgggttctcgctgaacaccttcgggatgtccgtgagctggattaggcagcccccgggaaaggccctggagtggctggccctgatcgattgggatgacgacaagtactactccacctcactccgcactcgcctgaccatctcaaaggacactgccaagaaccaagtggtgctgcggatgactaacatggacccgatggacaccgccacctattactgcgcccggatctacggaggcgacagaaccaacactcaggccccctacttcttcgatctgtggggacagggcactcttgtgaccgtgtcctcgggcggaggaggctccggtggagggggatcaggaggaggcggcagcgacgtcgtgatgactcaatccccgctgtccttgcctgtgacccctggcgaacccgcgtccattagctgccggagcagccagtccctcctgcactcgaacggatacaactacctggattggtatctgcagaagcccggccagtccccacaactcctgatctacctgggctctaatcgggcatccggggtcccggatcgcttcagcggttcgggctcgggtaccgacttcacgctgaagatttccagggtggaagctgaggacgtgggagtgtactactgcatgcaggcgcttcagactccatggacatttggacaggggaccaagctggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 400 - protein, 248 aa, Artificial Sequence
  Description of Artificial Sequence: Synthetic polypeptide
QVQLQESGPGLVKPSGTLSLTCAVSGASITSRHWWNWVRHSPGKGLEWIGQIYHSGTTTYNPSLGSRVTISVDKSKNQISLELRSVTAADTATYYCVRDYLELATYYGMDVWGQGTTVTVSSGGGGSGGGGSGGGGSEIVLTQSPLSLPVTPGEPASISCRSSQSLLYSDGYNYLDWYLQKPGQSPQLLIYLGSNRASGVPDRFSGSGSGTDFTLQISGVETEDVGVYYCMQALQTQSFGQGTKLEIK

SEQ ID NO: 401 - DNA, 744 bp, Artificial Sequence
  Description of Artificial Sequence: Synthetic polynucleotide
caagtgcagcttcaagaatcaggacctggcctcgtcaaaccctccggtaccctctccctcacctgtgccgtgtccggggcatctatcacctcccgccactggtggaactgggtcagacactccccgggaaagggattggagtggattggccagatctaccattccggcaccactacttacaacccgtccctgggctcccgcgtcactatctccgtggacaagtccaagaatcagattagcctggagctgcggtccgtgaccgctgccgataccgcgacctattactgcgtgcgggactacctggagctcgccacgtactacggaatggacgtctggggccagggcactaccgtgaccgtgtcaagcggggggggcggatcgggtggtggaggatcgggaggaggagggtcggaaatcgtgctgactcagtcccccctgtcgctgcctgtgactcctggggaaccagcctcaattagctgccgctcgagccagtccctgctgtattccgacggatacaactacctggattggtaccttcaaaagcccggccagagcccgcagctgctgatctacctgggttcaaacagggcctccggcgtgccggatcggttctcgggaagcggtagcgggacagacttcaccctgcaaatcagcggagtggaaactgaggacgtgggcgtgtactactgcatgcaggcgttgcagacccagtcctttggacaaggcaccaagctcgaaatcaag

SEQ ID NO: 402 - DNA, 837 bp, Artificial Sequence
  Description of Artificial Sequence: Synthetic polynucleotide
atggccctccctgtcaccgccctgctgcttccgctggctcttctgctccacgccgctcggccccaagtgcagcttcaagaatcaggacctggcctcgtcaaaccctccggtaccctctccctcacctgtgccgtgtccggggcatctatcacctcccgccactggtggaactgggtcagacactccccgggaaagggattggagtggattggccagatctaccattccggcaccactacttacaacccgtccctgggctcccgcgtcactatctccgtggacaagtccaagaatcagattagcctggagctgcggtccgtgaccgctgccgataccgcgacctattactgcgtgcgggactacctggagctcgccacgtactacggaatggacgtctggggccagggcactaccgtgaccgtgtcaagcggggggggcggatcgggtggtggaggatcgggaggaggagggtcggaaatcgtgctgactcagtcccccctgtcgctgcctgtgactcctggggaaccagcctcaattagctgccgctcgagccagtccctgctgtattccgacggatacaactacctggattggtaccttcaaaagcccggccagagcccgcagctgctgatctacctgggttcaaacagggcctccggcgtgccggatcggttctcgggaagcggtagcgggacagacttcaccctgcaaatcagcggagtggaaactgaggacgtgggcgtgtactactgcatgcaggcgttgcagacccagtcctttggacaaggcaccaagctcgaaatcaagggatcgcaccaccatcaccatcatcatcac

SEQ ID NO: 403 - protein, 279 aa, Artificial Sequence
  Description of Artificial Sequence: Synthetic polypeptide
MALPVTALLLPLALLLHAARPQVQLQESGPGLVKPSGTLSLTCAVSGASITSRHWWNWVRHSPGKGLEWIGQIYHSGTTTYNPSLGSRVTISVDKSKNQISLELRSVTAADTATYYCVRDYLELATYYGMDVWGQGTTVTVSSGGGGSGGGGSGGGGSEIVLTQSPLSLPVTPGEPASISCRSSQSLLYSDGYNYLDWYLQKPGQSPQLLIYLGSNRASGVPDRFSGSGSGTDFTLQISGVETEDVGVYYCMQALQTQSFGQGTKLEIKGSHHHHHHHH

SEQ ID NO: 404 - protein, 492 aa, Artificial Sequence
  Description of Artificial Sequence: Synthetic polypeptide
MALPVTALLLPLALLLHAARPQVQLQESGPGLVKPSGTLSLTCAVSGASITSRHWWNWVRHSPGKGLEWIGQIYHSGTTTYNPSLGSRVTISVDKSKNQISLELRSVTAADTATYYCVRDYLELATYYGMDVWGQGTTVTVSSGGGGSGGGGSGGGGSEIVLTQSPLSLPVTPGEPASISCRSSQSLLYSDGYNYLDWYLQKPGQSPQLLIYLGSNRASGVPDRFSGSGSGTDFTLQISGVETEDVGVYYCMQALQTQSFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 405 - DNA, 1476 bp, Artificial Sequence
  Description of Artificial Sequence: Synthetic polynucleotide
atggccctccctgtcaccgccctgctgcttccgctggctcttctgctccacgccgctcggccccaagtgcagcttcaagaatcaggacctggcctcgtcaaaccctccggtaccctctccctcacctgtgccgtgtccggggcatctatcacctcccgccactggtggaactgggtcagacactccccgggaaagggattggagtggattggccagatctaccattccggcaccactacttacaacccgtccctgggctcccgcgtcactatctccgtggacaagtccaagaatcagattagcctggagctgcggtccgtgaccgctgccgataccgcgacctattactgcgtgcgggactacctggagctcgccacgtactacggaatggacgtctggggccagggcactaccgtgaccgtgtcaagcggggggggcggatcgggtggtggaggatcgggaggaggagggtcggaaatcgtgctgactcagtcccccctgtcgctgcctgtgactcctggggaaccagcctcaattagctgccgctcgagccagtccctgctgtattccgacggatacaactacctggattggtaccttcaaaagcccggccagagcccgcagctgctgatctacctgggttcaaacagggcctccggcgtgccggatcggttctcgggaagcggtagcgggacagacttcaccctgcaaatcagcggagtggaaactgaggacgtgggcgtgtactactgcatgcaggcgttgcagacccagtcctttggacaaggcaccaagctcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 406 - protein, 247 aa, Artificial Sequence
  Description of Artificial Sequence: Synthetic polypeptide
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDLAAAGNYYYYGMDVWGQGTTVTVSSGGGGSGGGGSGGGGSSSELTQDPAVSVALGQTARITCQGDSLRSYFTSWYHQKPGQAPVLVIYGNNNRPSGIPDRFSGSSSGNTASLTITGAQAEDEGDYYCDSRDSSGDHLVFGGGTKLTVL

SEQ ID NO: 407 - DNA, 741 bp, Artificial Sequence
  Description of Artificial Sequence: Synthetic polynucleotide
caagtccaactcgtccagtccggtgcagaagtcaagaaaccaggagcttcagtgaaagtgtcgtgcaaggcctccggctataccttcacctcctactacatgcactgggtgcgccaggccccgggccagggactggagtggatgggaattatcaacccttcgggcggctccactagctacgcccaaaagtttcaggggagagtgaccatgactcgggacacctcaacctcgaccgtgtacatggaactgtcgtcactgcggtccgaggacaccgccgtgtactactgcgcgcgcgacttggccgccgcggggaattactactactacggaatggatgtctggggacagggaaccactgtgactgtgtcgtctggtggtggtggaagcgggggaggaggttcgggcggcggcggaagctcctccgaactgacccaggaccctgcggtgtccgtggccctgggacagaccgcaaggatcacgtgtcagggagacagcctccgctcctacttcacatcctggtatcatcagaagcccggccaggctccggtgctggtcatctacggaaacaacaacagaccgtccgggattcccgaccggttcagcggctcctcatccggcaacaccgcctccctgaccatcaccggcgcccaggccgaggacgagggagattactactgcgactcccgggatagcagcggcgatcacctcgtgttcgggggagggactaagcttactgtgctg

SEQ ID NO: 408 - DNA, 834 bp, Artificial Sequence
  Description of Artificial Sequence: Synthetic polynucleotide
atggccctccctgtcaccgccctgctgcttccgctggctcttctgctccacgccgctcggccccaagtccaactcgtccagtccggtgcagaagtcaagaaaccaggagcttcagtgaaagtgtcgtgcaaggcctccggctataccttcacctcctactacatgcactgggtgcgccaggccccgggccagggactggagtggatgggaattatcaacccttcgggcggctccactagctacgcccaaaagtttcaggggagagtgaccatgactcgggacacctcaacctcgaccgtgtacatggaactgtcgtcactgcggtccgaggacaccgccgtgtactactgcgcgcgcgacttggccgccgcggggaattactactactacggaatggatgtctggggacagggaaccactgtgactgtgtcgtctggtggtggtggaagcgggggaggaggttcgggcggcggcggaagctcctccgaactgacccaggaccctgcggtgtccgtggccctgggacagaccgcaaggatcacgtgtcagggagacagcctccgctcctacttcacatcctggtatcatcagaagcccggccaggctccggtgctggtcatctacggaaacaacaacagaccgtccgggattcccgaccggttcagcggctcctcatccggcaacaccgcctccctgaccatcaccggcgcccaggccgaggacgagggagattactactgcgactcccgggatagcagcggcgatcacctcgtgttcgggggagggactaagcttactgtgctgggatcgcaccaccatcaccatcatcatcac

SEQ ID NO: 409 - protein, 278 aa, Artificial Sequence
  Description of Artificial Sequence: Synthetic polypeptide
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDLAAAGNYYYYGMDVWGQGTTVTVSSGGGGSGGGGSGGGGSSSELTQDPAVSVALGQTARITCQGDSLRSYFTSWYHQKPGQAPVLVIYGNNNRPSGIPDRFSGSSSGNTASLTITGAQAEDEGDYYCDSRDSSGDHLVFGGGTKLTVLGSHHHHHHHH

SEQ ID NO: 410 - protein, 491 aa, Artificial Sequence
  Description of Artificial Sequence: Synthetic polypeptide
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDLAAAGNYYYYGMDVWGQGTTVTVSSGGGGSGGGGSGGGGSSSELTQDPAVSVALGQTARITCQGDSLRSYFTSWYHQKPGQAPVLVIYGNNNRPSGIPDRFSGSSSGNTASLTITGAQAEDEGDYYCDSRDSSGDHLVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 411 - DNA, 1473 bp, Artificial Sequence
  Description of Artificial Sequence: Synthetic polynucleotide
atggccctccctgtcaccgccctgctgcttccgctggctcttctgctccacgccgctcggccccaagtccaactcgtccagtccggtgcagaagtcaagaaaccaggagcttcagtgaaagtgtcgtgcaaggcctccggctataccttcacctcctactacatgcactgggtgcgccaggccccgggccagggactggagtggatgggaattatcaacccttcgggcggctccactagctacgcccaaaagtttcaggggagagtgaccatgactcgggacacctcaacctcgaccgtgtacatggaactgtcgtcactgcggtccgaggacaccgccgtgtactactgcgcgcgcgacttggccgccgcggggaattactactactacggaatggatgtctggggacagggaaccactgtgactgtgtcgtctggtggtggtggaagcgggggaggaggttcgggcggcggcggaagctcctccgaactgacccaggaccctgcggtgtccgtggccctgggacagaccgcaaggatcacgtgtcagggagacagcctccgctcctacttcacatcctggtatcatcagaagcccggccaggctccggtgctggtcatctacggaaacaacaacagaccgtccgggattcccgaccggttcagcggctcctcatccggcaacaccgcctccctgaccatcaccggcgcccaggccgaggacgagggagattactactgcgactcccgggatagcagcggcgatcacctcgtgttcgggggagggactaagcttactgtgctgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 412 - protein, 246 aa, Artificial Sequence
  Description of Artificial Sequence: Synthetic polypeptide
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDDDFWSGSGAFDIWGQGTTVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRDSSGNHPVVFGGGTKLTVL

SEQ ID NO: 413 - DNA, 738 bp, Artificial Sequence
  Description of Artificial Sequence: Synthetic polynucleotide
caagtccaactcgtccaatccggtgcagaagtcaagaaacctggagcttccgtgaaagtgtcctgcaaggcgtcaggctacacctttacgtcctactacatgcactgggtccgccaggccccgggccagggcttggagtggatgggaatcattaaccccagcggcggcagcactagctatgcccagaagttccagggtcgggtcaccatgactagagacacatccacctccaccgtgtacatggaactgagctccctgcggtccgaggataccgcggtgtactactgcgcccgcgatgacgacttctggtccggctcgggggcattcgacatctggggacagggcaccaccgtgactgtgtcctccggcggtggaggatcgggtggcggaggaagcggtggaggcggatcttcgtccgaactgactcaggaccctgccgtgtcggtggccctgggacagactgtgcgcatcacctgtcaaggagatagcctgaggtcgtactatgcctcctggtaccagcagaagcccggacaggccccggtgcttgtgatctacgggaagaacaacagaccgtcagggattccagaccggttcagcgggtcatccagcgggaataccgcttccctcactatcaccggagcccaggcggaggacgaggccgattactactgcaactcgcgggactcatccggcaaccatcccgtggtgttcggagggggcactaagctgaccgtgctg

SEQ ID NO: 414 - DNA, 831 bp, Artificial Sequence
  Description of Artificial Sequence: Synthetic polynucleotide
atggccctccctgtcaccgccctgctgcttccgctggctcttctgctccacgccgctcggccccaagtccaactcgtccaatccggtgcagaagtcaagaaacctggagcttccgtgaaagtgtcctgcaaggcgtcaggctacacctttacgtcctactacatgcactgggtccgccaggccccgggccagggcttggagtggatgggaatcattaaccccagcggcggcagcactagctatgcccagaagttccagggtcgggtcaccatgactagagacacatccacctccaccgtgtacatggaactgagctccctgcggtccgaggataccgcggtgtactactgcgcccgcgatgacgacttctggtccggctcgggggcattcgacatctggggacagggcaccaccgtgactgtgtcctccggcggtggaggatcgggtggcggaggaagcggtggaggcggatcttcgtccgaactgactcaggaccctgccgtgtcggtggccctgggacagactgtgcgcatcacctgtcaaggagatagcctgaggtcgtactatgcctcctggtaccagcagaagcccggacaggccccggtgcttgtgatctacgggaagaacaacagaccgtcagggattccagaccggttcagcgggtcatccagcgggaataccgcttccctcactatcaccggagcccaggcggaggacgaggccgattactactgcaactcgcgggactcatccggcaaccatcccgtggtgttcggagggggcactaagctgaccgtgctgggatcgcaccaccatcaccatcatcatcac

SEQ ID NO: 415 - protein, 277 aa, Artificial Sequence
  Description of Artificial Sequence: Synthetic polypeptide
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDDDFWSGSGAFDIWGQGTTVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRDSSGNHPVVFGGGTKLTVLGSHHHHHHHH

SEQ ID NO: 416 - protein, 490 aa, Artificial Sequence
  Description of Artificial Sequence: Synthetic polypeptide
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDDDFWSGSGAFDIWGQGTTVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRDSSGNHPVVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 417 - DNA, 1470 bp, Artificial Sequence
  Description of Artificial Sequence: Synthetic polynucleotide
atggccctccctgtcaccgccctgctgcttccgctggctcttctgctccacgccgctcggccccaagtccaactcgtccaatccggtgcagaagtcaagaaacctggagcttccgtgaaagtgtcctgcaaggcgtcaggctacacctttacgtcctactacatgcactgggtccgccaggccccgggccagggcttggagtggatgggaatcattaaccccagcggcggcagcactagctatgcccagaagttccagggtcgggtcaccatgactagagacacatccacctccaccgtgtacatggaactgagctccctgcggtccgaggataccgcggtgtactactgcgcccgcgatgacgacttctggtccggctcgggggcattcgacatctggggacagggcaccaccgtgactgtgtcctccggcggtggaggatcgggtggcggaggaagcggtggaggcggatcttcgtccgaactgactcaggaccctgccgtgtcggtggccctgggacagactgtgcgcatcacctgtcaaggagatagcctgaggtcgtactatgcctcctggtaccagcagaagcccggacaggccccggtgcttgtgatctacgggaagaacaacagaccgtcagggattccagaccggttcagcgggtcatccagcgggaataccgcttccctcactatcaccggagcccaggcggaggacgaggccgattactactgcaactcgcgggactcatccggcaaccatcccgtggtgttcggagggggcactaagctgaccgtgctgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 418 - protein, 248 aa, Artificial Sequence
  Description of Artificial Sequence: Synthetic polypeptide
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARPEGVSYYDSSVLDYWGQGTLVTVSSGGGGSGGGGSGGGGSQSALTQPASVSGSPGQSITISCTGTSSDVGGYKHVSWYQHHPGKAPKLMIYDVSNRPSGVSNRFSGSKSGNTASLTVSGLQAEDEAHYYCVSYRNFNSLVFGTGTKVTVL

SEQ ID NO: 419 - DNA, 837 bp, Artificial Sequence
  Description of Artificial Sequence: Synthetic polynucleotide
atggccctccctgtcaccgccctgctgcttccgctggctcttctgctccacgccgctcggccccaagtccaactcgtccagtccggtgcagaagtcaagaaacccggagcttccgtgaaagtgtcctgcaaggcctcggggtataccttcacttcctactacatgcactgggtccggcaggcgccgggacagggactggaatggatgggtatcatcaacccctcgggcggttccactagctacgcccagaagttccagggaagagtgaccatgacccgggacacttccacttcgaccgtgtacatggaactgagcagcctgaggagcgaggacaccgccgtgtactactgtgcccggcccgagggagtgtcctactacgattcctccgtgctggattactggggacagggaacacttgtgaccgtgtcctcgggaggaggcggaagcgggggcggagggtctgggggaggcggctcccagtccgctctgacgcagcctgcgtccgtgtccgggagccctggccagagcattactatttcatgcaccggtaccagctccgacgtgggcggatataagcacgtgtcatggtaccagcatcacccgggaaaggccccaaagctgatgatctacgacgtgtcgaacagaccgagcggggtgtcaaatcgcttttccggttcaaagtcgggcaacactgcctcactcaccgtgtcgggcctccaagcggaggacgaagcccactactactgcgtgtcctaccgcaacttcaactccttggtgttcggcaccggcaccaaggtcaccgtcctgggatcgcaccaccatcaccatcatcatcac

SEQ ID NO: 420 - protein, 279 aa, Artificial Sequence
  Description of Artificial Sequence: Synthetic polypeptide
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARPEGVSYYDSSVLDYWGQGTLVTVSSGGGGSGGGGSGGGGSQSALTQPASVSGSPGQSITISCTGTSSDVGGYKHVSWYQHHPGKAPKLMIYDVSNRPSGVSNRFSGSKSGNTASLTVSGLQAEDEAHYYCVSYRNFNSLVFGTGTKVTVLGSHHHHHHHH

SEQ ID NO: 421 - protein, 492 aa, Artificial Sequence
  Description of Artificial Sequence: Synthetic polypeptide
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARPEGVSYYDSSVLDYWGQGTLVTVSSGGGGSGGGGSGGGGSQSALTQPASVSGSPGQSITISCTGTSSDVGGYKHVSWYQHHPGKAPKLMIYDVSNRPSGVSNRFSGSKSGNTASLTVSGLQAEDEAHYYCVSYRNFNSLVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 422 - DNA, 1476 bp, Artificial Sequence
  Description of Artificial Sequence: Synthetic polynucleotide
atggccctccctgtcaccgccctgctgcttccgctggctcttctgctccacgccgctcggccccaagtccaactcgtccagtccggtgcagaagtcaagaaacccggagcttccgtgaaagtgtcctgcaaggcctcggggtataccttcacttcctactacatgcactgggtccggcaggcgccgggacagggactggaatggatgggtatcatcaacccctcgggcggttccactagctacgcccagaagttccagggaagagtgaccatgacccgggacacttccacttcgaccgtgtacatggaactgagcagcctgaggagcgaggacaccgccgtgtactactgtgcccggcccgagggagtgtcctactacgattcctccgtgctggattactggggacagggaacacttgtgaccgtgtcctcgggaggaggcggaagcgggggcggagggtctgggggaggcggctcccagtccgctctgacgcagcctgcgtccgtgtccgggagccctggccagagcattactatttcatgcaccggtaccagctccgacgtgggcggatataagcacgtgtcatggtaccagcatcacccgggaaaggccccaaagctgatgatctacgacgtgtcgaacagaccgagcggggtgtcaaatcgcttttccggttcaaagtcgggcaacactgcctcactcaccgtgtcgggcctccaagcggaggacgaagcccactactactgcgtgtcctaccgcaacttcaactccttggtgttcggcaccggcaccaaggtcaccgtcctgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 423 - protein, 246 aa, Artificial Sequence
  Description of Artificial Sequence: Synthetic polypeptide
QVQLVQSGAEVKKPGASVKVSCKASGYTFTSYYMHWVRQAPGQGLEWMGIINPSGGSTSYAQKFQGRVTMTRDTSTSTVYMELSSLRAEDTAVYYCARGGYGDYLDAFDIWGQGTTVTVSSGGGGSGGGGSGSGGSQSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLVFGTGTQLTVL

SEQ ID NO: 424 - DNA, 738 bp, Artificial Sequence
  Description of Artificial Sequence: Synthetic polynucleotide
caagtccaactcgtccaatccggtgcagaagtcaagaaacctggagcatccgtgaaagtgtcctgcaaggcgtccgggtatacgttcacctcctactacatgcactgggtgcgccaggccccgggacagggactggaatggatgggaatcatcaatcctagcggcggcagcaccagctacgcccagaagtttcagggccgcgtgaccatgaccagggacactagcacctccaccgtgtacatggaattgtccagcctgagagccgaggatactgctgtgtactactgcgcccggggcggatacggagattatctggacgccttcgacatttggggacagggcactactgtgaccgtgtcctcggggggaggcggctcggggggcggcggatcaggatcaggcggttcccagtccgcgctgacacagcccgcttccgtgagcggttcgcccgggcagtccatcaccatttcgtgtaccggaacttcctccgacgtcggtggctacaactacgtgtcgtggtaccagcaacatccgggaaaggccccaaagctcatgatctacgaggtgtccaaccggccgtccggggtgtcaaaccggttcagcggctcaaagagcggaaacaccgcctccctcaccatctcgggactgcaggccgaggatgaagcggactactactgctcgagctacacttcctcatctaccctggtgttcgggactggtacccagcttaccgtgctg

SEQ ID NO: 425 - DNA, 831 bp, Artificial Sequence
  Description of Artificial Sequence: Synthetic polynucleotide
atggccctccctgtcaccgccctgctgcttccgctggctcttctgctccacgccgctcggccccaagtccaactcgtccaatccggtgcagaagtcaagaaacctggagcatccgtgaaagtgtcctgcaaggcgtccgggtatacgttcacctcctactacatgcactgggtgcgccaggccccgggacagggactggaatggatgggaatcatcaatcctagcggcggcagcaccagctacgcccagaagtttcagggccgcgtgaccatgaccagggacactagcacctccaccgtgtacatggaattgtccagcctgagagccgaggatactgctgtgtactactgcgcccggggcggatacggagattatctggacgccttcgacatttggggacagggcactactgtgaccgtgtcctcggggggaggcggctcggggggcggcggatcaggatcaggcggttcccagtccgcgctgacacagcccgcttccgtgagcggttcgcccgggcagtccatcaccatttcgtgtaccggaacttcctccgacgtcggtggctacaactacgtgtcgtggtaccagcaacatccgggaaaggccccaaagctcatgatctacgaggtgtccaaccggccgtccggggtgtcaaaccggttcagcggctcaaagagcggaaacaccgcctccctcaccatctcgggactgcaggccgaggatgaagcggactactactgctcgagctacacttcctcatctaccctggtgttcgggactggtacccagcttaccgtgctgggatcgcaccaccatcaccatcatcatcac

SEQ ID NO: 426 - protein, 277 aa, Artificial Sequence
  Description of Artificial Sequence: Synthetic polypeptide
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSTSTVYMELSSLRAEDTAVYYCARGGYGDYLDAFDIWGQGTTVTVSSGGGGSGGGGSGSGGSQSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLVFGTGTQLTVLGSHHHHHHHH

SEQ ID NO: 427 - protein, 490 aa, Artificial Sequence
  Description of Artificial Sequence: Synthetic polypeptide
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSTSTVYMELSSLRAEDTAVYYCARGGYGDYLDAFDIWGQGTTVTVSSGGGGSGGGGSGSGGSQSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLVFGTGTQLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 428 - DNA, 1470 bp, Artificial Sequence
  Description of Artificial Sequence: Synthetic polynucleotide
atggccctccctgtcaccgccctgctgcttccgctggctcttctgctccacgccgctcggccccaagtccaactcgtccaatccggtgcagaagtcaagaaacctggagcatccgtgaaagtgtcctgcaaggcgtccgggtatacgttcacctcctactacatgcactgggtgcgccaggccccgggacagggactggaatggatgggaatcatcaatcctagcggcggcagcaccagctacgcccagaagtttcagggccgcgtgaccatgaccagggacactagcacctccaccgtgtacatggaattgtccagcctgagagccgaggatactgctgtgtactactgcgcccggggcggatacggagattatctggacgccttcgacatttggggacagggcactactgtgaccgtgtcctcggggggaggcggctcggggggcggcggatcaggatcaggcggttcccagtccgcgctgacacagcccgcttccgtgagcggttcgcccgggcagtccatcaccatttcgtgtaccggaacttcctccgacgtcggtggctacaactacgtgtcgtggtaccagcaacatccgggaaaggccccaaagctcatgatctacgaggtgtccaaccggccgtccggggtgtcaaaccggttcagcggctcaaagagcggaaacaccgcctccctcaccatctcgggactgcaggccgaggatgaagcggactactactgctcgagctacacttcctcatctaccctggtgttcgggactggtacccagcttaccgtgctgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 429 - protein, 17 aa, Artificial Sequence
  Description of Artificial Sequence: Synthetic peptide
IINPSGGSTSYAQKFQG

SEQ ID NO: 430 - protein, 17 aa, Artificial Sequence
  Description of Artificial Sequence: Synthetic peptide
IINPSGGSTSYAQKFQG

SEQ ID NO: 431 - protein, 17 aa, Artificial Sequence
  Description of Artificial Sequence: Synthetic peptide
IINPSGGSTSYAQKFQG

SEQ ID NO: 432 - protein, 17 aa, Artificial Sequence
  Description of Artificial Sequence: Synthetic peptide
GIIPIFGTANYAQKFQG

SEQ ID NO: 433 - protein, 17 aa, Artificial Sequence
  Description of Artificial Sequence: Synthetic peptide
IINPSGGSTSYAQKFQG

SEQ ID NO: 434 - protein, 17 aa, Artificial Sequence
  Description of Artificial Sequence: Synthetic peptide
YISSSSSTIYYADSVKG

SEQ ID NO: 435 - protein, 17 aa, Artificial Sequence
  Description of Artificial Sequence: Synthetic peptide
IINPSGGSTSYAQKFQG

SEQ ID NO: 436 - protein, 17 aa, Artificial Sequence
  Description of Artificial Sequence: Synthetic peptide
IIYPGDSDTRYSPSFQG

SEQ ID NO: 437 - protein, 16 aa, Artificial Sequence
  Description of Artificial Sequence: Synthetic peptide
FTSHSGNVKYNPSLTG

SEQ ID NO: 438 - protein, 17 aa, Artificial Sequence
  Description of Artificial Sequence: Synthetic peptide
YISSSGSTIYYADSVKG

SEQ ID NO: 439 - protein, 17 aa, Artificial Sequence
  Description of Artificial Sequence: Synthetic peptide
IINPSGGSTSYAQKFQG

SEQ ID NO: 440 - protein, 17 aa, Artificial Sequence
  Description of Artificial Sequence: Synthetic peptide
WINPNSGGTNYAQKFQG

SEQ ID NO: 441 - protein, 17 aa, Artificial Sequence
  Description of Artificial Sequence: Synthetic peptide
WMNPNSGNTGYAQKFQG

SEQ ID NO: 442 - protein, 17 aa, Artificial Sequence
  Description of Artificial Sequence: Synthetic peptide
WISAYNGNTNYAQKLQG

SEQ ID NO: 443 - protein, 16 aa, Artificial Sequence
  Description of Artificial Sequence: Synthetic peptide
LIDWDDDKYYSTSLRT

SEQ ID NO: 444 - protein, 16 aa, Artificial Sequence
  Description of Artificial Sequence: Synthetic peptide
QIYHSGTTTYNPSLGS

SEQ ID NO: 445 - protein, 17 aa, Artificial Sequence
  Description of Artificial Sequence: Synthetic peptide
IINPSGGSTSYAQKFQG

SEQ ID NO: 446 - protein, 17 aa, Artificial Sequence
  Description of Artificial Sequence: Synthetic peptide
IINPSGGSTSYAQKFQG

SEQ ID NO: 447 - protein, 17 aa, Artificial Sequence
  Description of Artificial Sequence: Synthetic peptide
IINPSGGSTSYAQKFQG

SEQ ID NO: 448 - protein, 17 aa, Artificial Sequence
  Description of Artificial Sequence: Synthetic peptide
IINPSGGSTSYAQKFQG

SEQ ID NO: 449 - protein, 12 aa, Artificial Sequence
  Description of Artificial Sequence: Synthetic peptide
EVTGDLEDAFDI

SEQ ID NO: 450 - protein, 18 aa, Artificial Sequence
  Description of Artificial Sequence: Synthetic peptide
QSTPYDSSGYYSGDAFDI

SEQ ID NO: 451 - protein, 13 aa, Artificial Sequence
  Description of Artificial Sequence: Synthetic peptide
DLGWIAVAGTFDY

SEQ ID NO: 452 - protein, 15 aa, Artificial Sequence
  Description of Artificial Sequence: Synthetic peptide
DRLQDGNSWSDAFDV

SEQ ID NO: 453 - protein, 13 aa, Artificial Sequence
  Description of Artificial Sequence: Synthetic peptide
GLSSWHFHDALDI

SEQ ID NO: 454 - protein, 15 aa, Artificial Sequence
  Description of Artificial Sequence: Synthetic peptide
DKGGGYYDFWSGSDY

SEQ ID NO: 455 - protein, 9 aa, Artificial Sequence
  Description of Artificial Sequence: Synthetic peptide
EGSGSYYAY

SEQ ID NO: 456 - protein, 13 aa, Artificial Sequence
  Description of Artificial Sequence: Synthetic peptide
DYWGYYGSGTLDY

SEQ ID NO: 457 - protein, 19 aa, Artificial Sequence
  Description of Artificial Sequence: Synthetic peptide
AGLALYSNYVPYYYYGMDV

SEQ ID NO: 458 - protein, 5 aa, Artificial Sequence
  Description of Artificial Sequence: Synthetic peptide
GATDV

SEQ ID NO: 459 - protein, 15 aa, Artificial Sequence
  Description of Artificial Sequence: Synthetic peptide
DRLQDGNSWSDAFDV

SEQ ID NO: 460 - protein, 15 aa, Artificial Sequence
  Description of Artificial Sequence: Synthetic peptide
EESSSGWYEGNWFDP

SEQ ID NO: 461 - protein, 15 aa, Artificial Sequence
  Description of Artificial Sequence: Synthetic peptide
DRLQDGNSWSDAFDV

SEQ ID NO: 462 - protein, 10 aa, Artificial Sequence
  Description of Artificial Sequence: Synthetic peptide
GRMDTAMAQI

SEQ ID NO: 463 - protein, 8 aa, Artificial Sequence
  Description of Artificial Sequence: Synthetic peptide
DLDVSLDI

SEQ ID NO: 464 - protein, 14 aa, Artificial Sequence
  Description of Artificial Sequence: Synthetic peptide
VHSSGYYHPGPNDY

SEQ ID NO: 465 - protein, 9 aa, Artificial Sequence
  Description of Artificial Sequence: Synthetic peptide
EAGVVAVDY

SEQ ID NO: 466 - protein, 13 aa, Artificial Sequence
  Description of Artificial Sequence: Synthetic peptide
EPLFGVVEEDVDY

SEQ ID NO: 467 - protein, 11 aa, Artificial Sequence
  Description of Artificial Sequence: Synthetic peptide
GSGSLGDAFDI

SEQ ID NO: 468 - protein, 12 aa, Artificial Sequence
  Description of Artificial Sequence: Synthetic peptide
DGFGELSGAFDI

SEQ ID NO: 469 - protein, 13 aa, Artificial Sequence
  Description of Artificial Sequence: Synthetic peptide
GPIGCSGGSCLDY

SEQ ID NO: 470 - protein, 12 aa, Artificial Sequence
  Description of Artificial Sequence: Synthetic peptide
GSYGDYGDAFDI

SEQ ID NO: 471 - protein, 9 aa, Artificial Sequence
  Description of Artificial Sequence: Synthetic peptide
DHKVVRFGY

SEQ ID NO: 472 - protein, 7 aa, Artificial Sequence
  Description of Artificial Sequence: Synthetic peptide
GDYYMDV

SEQ ID NO: 473 - protein, 15 aa, Artificial Sequence
  Description of Artificial Sequence: Synthetic peptide
DGPIRYFDHSKAFDI

SEQ ID NO: 474 - protein, 10 aa, Artificial Sequence
  Description of Artificial Sequence: Synthetic peptide
EMDDSSGPDY

SEQ ID NO: 475 - protein, 14 aa, Artificial Sequence
  Description of Artificial Sequence: Synthetic peptide
GFLRGGDCCGALDI

SEQ ID NO: 476 - protein, 13 aa, Artificial Sequence
  Description of Artificial Sequence: Synthetic peptide
GLDPLFAYDAFEI

SEQ ID NO: 477 - protein, 10 aa, Artificial Sequence
  Description of Artificial Sequence: Synthetic peptide
DDFWSGSVDY

SEQ ID NO: 478 - protein, 13 aa, Artificial Sequence
  Description of Artificial Sequence: Synthetic peptide
EDDSSGYTSPFDY

SEQ ID NO: 479 - protein, 16 aa, Artificial Sequence
  Description of Artificial Sequence: Synthetic peptide
EPASSSWYGYYYYMDV

SEQ ID NO: 480 - protein, 13 aa, Artificial Sequence
  Description of Artificial Sequence: Synthetic peptide
GDSNYWSYYGMDV

SEQ ID NO: 481 - protein, 9 aa, Artificial Sequence
  Description of Artificial Sequence: Synthetic peptide
FSSSDSYDY

SEQ ID NO: 482 - protein, 17 aa, Artificial Sequence
  Description of Artificial Sequence: Synthetic peptide
IYGGDRTNTQAPYFFDL

SEQ ID NO: 483 - protein, 13 aa, Artificial Sequence
  Description of Artificial Sequence: Synthetic peptide
DYLELATYYGMDV

SEQ ID NO: 484 - protein, 15 aa, Artificial Sequence
  Description of Artificial Sequence: Synthetic peptide
DLAAAGNYYYYGMDV

SEQ ID NO: 485 - protein, 13 aa, Artificial Sequence
  Description of Artificial Sequence: Synthetic peptide
DDDFWSGSGAFDI

SEQ ID NO: 486 - protein, 14 aa, Artificial Sequence
  Description of Artificial Sequence: Synthetic peptide
PEGVSYYDSSVLDY

SEQ ID NO: 487 - protein, 12 aa, Artificial Sequence
  Description of Artificial Sequence: Synthetic peptide
GGYGDYLDAFDI

SEQ ID NO: 488 - protein, 7 aa, Artificial Sequence
  Description of Artificial Sequence: Synthetic peptide
SNSAAWN

SEQ ID NO: 489 - protein, 9 aa, Artificial Sequence
  Description of Artificial Sequence: Synthetic peptide
GDSVSSNSA

SEQ ID NO: 490 - protein, 12 aa, Artificial Sequence
  Description of Artificial Sequence: Synthetic peptide
GDSVSNNNAAWN

SEQ ID NO: 491 - protein, 12 aa, Artificial Sequence
  Description of Artificial Sequence: Synthetic peptide
GDSVSSNSAAWN

SEQ ID NO: 492 - protein, 12 aa, Artificial Sequence
  Description of Artificial Sequence: Synthetic peptide
GDSVLSNSDTWN

SEQ ID NO: 493 - protein, 12 aa, Artificial Sequence
  Description of Artificial Sequence: Synthetic peptide
GDSVLSNSDTWN

SEQ ID NO: 494 - protein, 12 aa, Artificial Sequence
  Description of Artificial Sequence: Synthetic peptide
GDSVLSNSDTWN

SEQ ID NO: 495 - protein, 12 aa, Artificial Sequence
  Description of Artificial Sequence: Synthetic peptide
GDSVLSNSDTWN

SEQ ID NO: 496 - protein, 12 aa, Artificial Sequence
  Description of Artificial Sequence: Synthetic peptide
GDSVLSNSDTWN

SEQ ID NO: 497 - protein, 12 aa, Artificial Sequence
  Description of Artificial Sequence: Synthetic peptide
GDSVLSNSDTWN

SEQ ID NO: 498 - protein, 12 aa, Artificial Sequence
  Description of Artificial Sequence: Synthetic peptide
GDSMLSNSDTWN

SEQ ID NO: 499 - protein, 18 aa, Artificial Sequence
  Description of Artificial Sequence: Synthetic peptide
RTYYRSKWYSDYAVSVKS

SEQ ID NO: 500 - protein, 7 aa, Artificial Sequence
  Description of Artificial Sequence: Synthetic peptide
YYRSKWY

SEQ ID NO: 501 - protein, 18 aa, Artificial Sequence
  Description of Artificial Sequence: Synthetic peptide
RTYHRSTWYNDYVGSVKS

SEQ ID NO: 502 - protein, 18 aa, Artificial Sequence
  Description of Artificial Sequence: Synthetic peptide
RTFYRSKWYNDYAVSVKG

SEQ ID NO: 503 - protein, 18 aa, Artificial Sequence
  Description of Artificial Sequence: Synthetic peptide
RTYHRSTWYDDYASSVRG

SEQ ID NO: 504 - protein, 18 aa, Artificial Sequence
  Description of Artificial Sequence: Synthetic peptide
RTYHRSTWYDDYASSVRG

SEQ ID NO: 505 - protein, 18 aa, Artificial Sequence
  Description of Artificial Sequence: Synthetic peptide
RTYHRSTWYDDYASSVRG

SEQ ID NO: 506 - protein, 18 aa, Artificial Sequence
  Description of Artificial Sequence: Synthetic peptide
RTYHRSTWYDDYASSVRG

SEQ ID NO: 507 - protein, 18 aa, Artificial Sequence
  Description of Artificial Sequence: Synthetic peptide
RTYHRSTWYDDYASSVRG

SEQ ID NO: 508 - protein, 18 aa, Artificial Sequence
  Description of Artificial Sequence: Synthetic peptide
RTYHRSTWYDDYASSVRG

SEQ ID NO: 509 - protein, 18 aa, Artificial Sequence
  Description of Artificial Sequence: Synthetic peptide
RTYHRSTWYDDYASSVRG

SEQ ID NO: 510 - protein, 15 aa, Artificial Sequence
  Description of Artificial Sequence: Synthetic peptide
DPYDFWSGYPDAFDI

SEQ ID NO: 511 - protein, 15 aa, Artificial Sequence
  Description of Artificial Sequence: Synthetic peptide
DPYDFWSGYPDAFDI

SEQ ID NO: 512 - protein, 12 aa, Artificial Sequence
  Description of Artificial Sequence: Synthetic peptide
ETDYGDYGAFDI

SEQ ID NO: 513 - protein, 9 aa, Artificial Sequence
  Description of Artificial Sequence: Synthetic peptide
GDYYYGLDV

SEQ ID NO: 514 - protein, 15 aa, Artificial Sequence
  Description of Artificial Sequence: Synthetic peptide
DRLQDGNSWSDAFDV

SEQ ID NO: 515 - protein, 15 aa, Artificial Sequence
  Description of Artificial Sequence: Synthetic peptide
DRLQDGNSWSDAFDV

SEQ ID NO: 516 - protein, 15 aa, Artificial Sequence
  Description of Artificial Sequence: Synthetic peptide
DRLQDGNSWSDAFDV

SEQ ID NO: 517 - protein, 15 aa, Artificial Sequence
  Description of Artificial Sequence: Synthetic peptide
DRLQDGNSWSDAFDV

SEQ ID NO: 518 - protein, 15 aa, Artificial Sequence
  Description of Artificial Sequence: Synthetic peptide
DRLQDGNSWSDAFDV

SEQ ID NO: 519 - protein, 15 aa, Artificial Sequence
  Description of Artificial Sequence: Synthetic peptide
VRLQDGNSWSDAFDV

SEQ ID NO: 520 - protein, 15 aa, Artificial Sequence
  Description of Artificial Sequence: Synthetic peptide
VRLQDGNSWSDAFDV

SEQ ID NO: 521 - protein, 11 aa, Artificial Sequence
  Description of Artificial Sequence: Synthetic peptide
RASQTIWSYLN

SEQ ID NO: 522 - protein, 13 aa, Artificial Sequence
  Description of Artificial Sequence: Synthetic peptide
SGSSSNIGSNYVY

SEQ ID NO: 523 - protein, 14 aa, Artificial Sequence
  Description of Artificial Sequence: Synthetic peptide
TGTSSDVGGYNYVS

SEQ ID NO: 524 - protein, 14 aa, Artificial Sequence
  Description of Artificial Sequence: Synthetic peptide
TGTSSDVGGYNYVS

SEQ ID NO: 525 - protein, 11 aa, Artificial Sequence
  Description of Artificial Sequence: Synthetic peptide
QGDSLRSYYAS

SEQ ID NO: 526 - protein, 11 aa, Artificial Sequence
  Description of Artificial Sequence: Synthetic peptide
QGDSLRSYYAS

SEQ ID NO: 527 - protein, 14 aa, Artificial Sequence
  Description of Artificial Sequence: Synthetic peptide
TGTSSDVGGYNYVS

SEQ ID NO: 528 - protein, 14 aa, Artificial Sequence
  Description of Artificial Sequence: Synthetic peptide
TGTSSDVGGYNYVS

SEQ ID NO: 529 - protein, 13 aa, Artificial Sequence
  Description of Artificial Sequence: Synthetic peptide
TRSSGSIASNYVQ

SEQ ID NO: 530 - protein, 13 aa, Artificial Sequence
  Description of Artificial Sequence: Synthetic peptide
SGSSSNIGSNYVY

SEQ ID NO: 531 - protein, 14 aa, Artificial Sequence
  Description of Artificial Sequence: Synthetic peptide
TGTSSDVGGYNYVS

SEQ ID NO: 532 - protein, 11 aa, Artificial Sequence
  Description of Artificial Sequence: Synthetic peptide
QGDSLRSYYAS

SEQ ID NO: 533 - protein, 14 aa, Artificial Sequence
  Description of Artificial Sequence: Synthetic peptide
TGTSSDVGGYNYVS

SEQ ID NO: 534 - protein, 13 aa, Artificial Sequence
  Description of Artificial Sequence: Synthetic peptide
TGSSGSFASSYVQ

SEQ ID NO: 535 - protein, 14 aa, Artificial Sequence
  Description of Artificial Sequence: Synthetic peptide
SGTSSDVGGYNSVS

SEQ ID NO: 536 - protein, 11 aa, Artificial Sequence
  Description of Artificial Sequence: Synthetic peptide
QGDSLRTYYAT

SEQ ID NO: 537 - protein, 14 aa, Artificial Sequence
  Description of Artificial Sequence: Synthetic peptide
TGTSSDVGGYNYVS

SEQ ID NO: 538 - protein, 16 aa, Artificial Sequence
  Description of Artificial Sequence: Synthetic peptide
RSSQSLLAGNGHNYLD

SEQ ID NO: 539 - protein, 14 aa, Artificial Sequence
  Description of Artificial Sequence: Synthetic peptide
TGSSSDVGGYNYVS

SEQ ID NO: 540 - protein, 14 aa, Artificial Sequence
  Description of Artificial Sequence: Synthetic peptide
TGTSSDVGGYNYVS

SEQ ID NO: 541 - protein, 14 aa, Artificial Sequence
  Description of Artificial Sequence: Synthetic peptide
TGTNSDVGRYNYVS

SEQ ID NO: 542 - protein, 14 aa, Artificial Sequence
  Description of Artificial Sequence: Synthetic peptide
TGTSSDVGGYKYVS

SEQ ID NO: 543 - protein, 12 aa, Artificial Sequence
  Description of Artificial Sequence: Synthetic peptide
TLSSGHSSYAIA

SEQ ID NO: 544 - protein, 14 aa, Artificial Sequence
  Description of Artificial Sequence: Synthetic peptide
TGTSSDVGGYNYVS

SEQ ID NO: 545 - protein, 11 aa, Artificial Sequence
  Description of Artificial Sequence: Synthetic peptide
QGDSLRSYYAS

SEQ ID NO: 546 - protein, 14 aa, Artificial Sequence
  Description of Artificial Sequence: Synthetic peptide
TGTSSDVGGYNYVS

SEQ ID NO: 547 - protein, 16 aa, Artificial Sequence
  Description of Artificial Sequence: Synthetic peptide
RSSQSLLHSNGYNYLD

SEQ ID NO: 548 - protein, 16 aa, Artificial Sequence
  Description of Artificial Sequence: Synthetic peptide
RSSQSLLHSNGYNYLD

SEQ ID NO: 549 - protein, 11 aa, Artificial Sequence
  Description of Artificial Sequence: Synthetic peptide
GGTNIGSKNVH

SEQ ID NO: 550 - protein, 11 aa, Artificial Sequence
  Description of Artificial Sequence: Synthetic peptide
GGHNIRSKNVH

SEQ ID NO: 551 - protein, 11 aa, Artificial Sequence
  Description of Artificial Sequence: Synthetic peptide
RASQSINTYLN

SEQ ID NO: 552 - protein, 14 aa, Artificial Sequence
  Description of Artificial Sequence: Synthetic peptide
TGTSSDVGGYNYVS

SEQ ID NO: 553 - protein, 11 aa, Artificial Sequence
  Description of Artificial Sequence: Synthetic peptide
RASQSVTSNLA

SEQ ID NO: 554 - protein, 16 aa, Artificial Sequence
  Description of Artificial Sequence: Synthetic peptide
RSSQSLLHSNGYNYLD

SEQ ID NO: 555 - protein, 16 aa, Artificial Sequence
  Description of Artificial Sequence: Synthetic peptide
RSSQSLLYSDGYNYLD

SEQ ID NO: 556 - protein, 11 aa, Artificial Sequence
  Description of Artificial Sequence: Synthetic peptide
QGDSLRSYFTS

SEQ ID NO: 557 - protein, 11 aa, Artificial Sequence
  Description of Artificial Sequence: Synthetic peptide
QGDSLRSYYAS

SEQ ID NO: 558 - protein, 14 aa, Artificial Sequence
  Description of Artificial Sequence: Synthetic peptide
TGTSSDVGGYKHVS

SEQ ID NO: 559 - protein, 14 aa, Artificial Sequence
  Description of Artificial Sequence: Synthetic peptide
TGTSSDVGGYNYVS

SEQ ID NO: 560 - protein, 7 aa, Artificial Sequence
  Description of Artificial Sequence: Synthetic peptide
AASSLQS

SEQ ID NO: 561 - protein, 7 aa, Artificial Sequence
  Description of Artificial Sequence: Synthetic peptide
RNNQRPS

SEQ ID NO: 562 - protein, 7 aa, Artificial Sequence
  Description of Artificial Sequence: Synthetic peptide
DVSKRPS

SEQ ID NO: 563 - protein, 7 aa, Artificial Sequence
  Description of Artificial Sequence: Synthetic peptide
DVSNRPS

SEQ ID NO: 564 - protein, 7 aa, Artificial Sequence
  Description of Artificial Sequence: Synthetic peptide
GKNNRPS

SEQ ID NO: 565 - protein, 7 aa, Artificial Sequence
  Description of Artificial Sequence: Synthetic peptide
GKNNRPS

SEQ ID NO: 566 - protein, 7 aa, Artificial Sequence
  Description of Artificial Sequence: Synthetic peptide
DVSNRPS

SEQ ID NO: 567 - protein, 7 aa, Artificial Sequence
  Description of Artificial Sequence: Synthetic peptide
DVSSRPS

SEQ ID NO: 568 - protein, 7 aa, Artificial Sequence
  Description of Artificial Sequence: Synthetic peptide
EDNQRPS

SEQ ID NO: 569 - protein, 7 aa, Artificial Sequence
  Description of Artificial Sequence: Synthetic peptide
RNNQRPS

SEQ ID NO: 570 - protein, 7 aa, Artificial Sequence
  Description of Artificial Sequence: Synthetic peptide
DVSNRPS

SEQ ID NO: 571 - protein, 7 aa, Artificial Sequence
  Description of Artificial Sequence: Synthetic peptide
GKNHRPS

SEQ ID NO: 572 - protein, 7 aa, Artificial Sequence
  Description of Artificial Sequence: Synthetic peptide
DVSNRPS

SEQ ID NO: 573 - protein, 7 aa, Artificial Sequence
  Description of Artificial Sequence: Synthetic peptide
EDNQRPS

SEQ ID NO: 574 - protein, 7 aa, Artificial Sequence
  Description of Artificial Sequence: Synthetic peptide
DVNNRPS

SEQ ID NO: 575 - protein, 7 aa, Artificial Sequence
  Description of Artificial Sequence: Synthetic peptide
DENNRPS

SEQ ID NO: 576 - protein, 7 aa, Artificial Sequence
  Description of Artificial Sequence: Synthetic peptide
DVSNRPS

SEQ ID NO: 577 - protein, 7 aa, Artificial Sequence
  Description of Artificial Sequence: Synthetic peptide
LGSNRAS

SEQ ID NO: 578 - protein, 7 aa, Artificial Sequence
  Description of Artificial Sequence: Synthetic peptide
EVSNRPS

SEQ ID NO: 579 - protein, 7 aa, Artificial Sequence
  Description of Artificial Sequence: Synthetic peptide
DVSNRPS

SEQ ID NO: 580 - protein, 7 aa, Artificial Sequence
  Description of Artificial Sequence: Synthetic peptide
EVSYRPS

SEQ ID NO: 581 - protein, 7 aa, Artificial Sequence
  Description of Artificial Sequence: Synthetic peptide
DVSNRPS

SEQ ID NO: 582 - protein, 11 aa, Artificial Sequence
  Description of Artificial Sequence: Synthetic peptide
VNSDGSLSKGD

SEQ ID NO: 583 - protein, 7 aa, Artificial Sequence
  Description of Artificial Sequence: Synthetic peptide
EVSKRPS

SEQ ID NO: 584 - protein, 7 aa, Artificial Sequence
  Description of Artificial Sequence: Synthetic peptide
GKNNRPS

SEQ ID NO: 585 - protein, 7 aa, Artificial Sequence
  Description of Artificial Sequence: Synthetic peptide
EVSNRPS

SEQ ID NO: 586 - protein, 7 aa, Artificial Sequence
  Description of Artificial Sequence: Synthetic peptide
LGSNRAS

SEQ ID NO: 587 - protein, 7 aa, Artificial Sequence
  Description of Artificial Sequence: Synthetic peptide
LGSNRAS

SEQ ID NO: 588 - protein, 7 aa, Artificial Sequence
  Description of Artificial Sequence: Synthetic peptide
YDSDRPS

SEQ ID NO: 589 - protein, 7 aa, Artificial Sequence
  Description of Artificial Sequence: Synthetic peptide
YDGDRPS

SEQ ID NO: 590 - protein, 7 aa, Artificial Sequence
  Description of Artificial Sequence: Synthetic peptide
AASNLQS

SEQ ID NO: 591 - protein, 7 aa, Artificial Sequence
  Description of Artificial Sequence: Synthetic peptide
DADKRPS

SEQ ID NO: 592 - protein, 7 aa, Artificial Sequence
  Description of Artificial Sequence: Synthetic peptide
AASTRAT

SEQ ID NO: 593 - protein, 7 aa, Artificial Sequence
  Description of Artificial Sequence: Synthetic peptide
LGSNRAS

SEQ ID NO: 594 - protein, 7 aa, Artificial Sequence
  Description of Artificial Sequence: Synthetic peptide
LGSNRAS

SEQ ID NO: 595 - protein, 7 aa, Artificial Sequence
  Description of Artificial Sequence: Synthetic peptide
GNNNRPS

SEQ ID NO: 596 - protein, 7 aa, Artificial Sequence
  Description of Artificial Sequence: Synthetic peptide
GKNNRPS

SEQ ID NO: 597 - protein, 7 aa, Artificial Sequence
  Description of Artificial Sequence: Synthetic peptide
DVSNRPS

SEQ ID NO: 598 - protein, 7 aa, Artificial Sequence
  Description of Artificial Sequence: Synthetic peptide
EVSNRPS

SEQ ID NO: 599 - protein, 9 aa, Artificial Sequence
  Description of Artificial Sequence: Synthetic peptide
QQSYSIPQT

SEQ ID NO: 600 - protein, 11 aa, Artificial Sequence
  Description of Artificial Sequence: Synthetic peptide
AAWDDSLSGYV

SEQ ID NO: 601 - protein, 11 aa, Artificial Sequence
  Description of Artificial Sequence: Synthetic peptide
SSYTSSSLNHV

SEQ ID NO: 602 - protein, 11 aa, Artificial Sequence
  Description of Artificial Sequence: Synthetic peptide
SSYTSSSTPYV

SEQ ID NO: 603 - protein, 12 aa, Artificial Sequence
  Description of Artificial Sequence: Synthetic peptide
NSRDSSGNHLWV

SEQ ID NO: 604 - protein, 9 aa, Artificial Sequence
  Description of Artificial Sequence: Synthetic peptide
NSRDSSGWV

SEQ ID NO: 605 - protein, 11 aa, Artificial Sequence
  Description of Artificial Sequence: Synthetic peptide
SSYTSSSTLYV

SEQ ID NO: 606 - protein, 10 aa, Artificial Sequence
  Description of Artificial Sequence: Synthetic peptide
SSYAGSNTLV

SEQ ID NO: 607 - protein, 10 aa, Artificial Sequence
  Description of Artificial Sequence: Synthetic peptide
QSYDSSNPWV

SEQ ID NO: 608 - protein, 11 aa, Artificial Sequence
  Description of Artificial Sequence: Synthetic peptide
AAWDDSLSGPV

SEQ ID NO: 609 - protein, 12 aa, Artificial Sequence
  Description of Artificial Sequence: Synthetic peptide
SSYTSSSTLVYV

SEQ ID NO: 610 - protein, 10 aa, Artificial Sequence
  Description of Artificial Sequence: Synthetic peptide
HSRDSSGNHL

SEQ ID NO: 611 - protein, 11 aa, Artificial Sequence
  Description of Artificial Sequence: Synthetic peptide
SSYTSSSTLYV

SEQ ID NO: 612 - protein, 9 aa, Artificial Sequence
  Description of Artificial Sequence: Synthetic peptide
QSYDGATWV

SEQ ID NO: 613 - protein, 10 aa, Artificial Sequence
  Description of Artificial Sequence: Synthetic peptide
SSYTSSSTLF

SEQ ID NO: 614 - protein, 12 aa, Artificial Sequence
  Description of Artificial Sequence: Synthetic peptide
SSRDSSGNPSCV

SEQ ID NO: 615 - protein, 10 aa, Artificial Sequence
  Description of Artificial Sequence: Synthetic peptide
SSYTSSSTWV

SEQ ID NO: 616 - protein, 9 aa, Artificial Sequence
  Description of Artificial Sequence: Synthetic peptide
MQALQNPLT

SEQ ID NO: 617 - protein, 10 aa, Artificial Sequence
  Description of Artificial Sequence: Synthetic peptide
SSYTSSSTLV

SEQ ID NO: 618 - protein, 10 aa, Artificial Sequence
  Description of Artificial Sequence: Synthetic peptide
SSYASSSTLV

SEQ ID NO: 619 - protein, 10 aa, Artificial Sequence
  Description of Artificial Sequence: Synthetic peptide
SSYTTSSTLD

SEQ ID NO: 620 - protein, 10 aa, Artificial Sequence
  Description of Artificial Sequence: Synthetic peptide
SSYTSSSTLV

SEQ ID NO: 621 - protein, 9 aa, Artificial Sequence
  Description of Artificial Sequence: Synthetic peptide
QTWGSGMAI

SEQ ID NO: 622 - protein, 10 aa, Artificial Sequence
  Description of Artificial Sequence: Synthetic peptide
SSYTSSGTLV

SEQ ID NO: 623 - protein, 11 aa, Artificial Sequence
  Description of Artificial Sequence: Synthetic peptide
NSRDSSGNPYV

SEQ ID NO: 624 - protein, 10 aa, Artificial Sequence
  Description of Artificial Sequence: Synthetic peptide
SSYTSSSTLV

SEQ ID NO: 625 - protein, 10 aa, Artificial Sequence
  Description of Artificial Sequence: Synthetic peptide
MQALQTPPWT

SEQ ID NO: 626 - protein, 10 aa, Artificial Sequence
  Description of Artificial Sequence: Synthetic peptide
MQVLQTPPLT

SEQ ID NO: 627 - protein, 11 aa, Artificial Sequence
  Description of Artificial Sequence: Synthetic peptide
QVWDSSSDHWV

SEQ ID NO: 628 - protein, 11 aa, Artificial Sequence
  Description of Artificial Sequence: Synthetic peptide
QVWDSDSDHYV

SEQ ID NO: 629 - protein, 9 aa, Artificial Sequence
  Description of Artificial Sequence: Synthetic peptide
QQSYSSLLT

SEQ ID NO: 630 - protein, 10 aa, Artificial Sequence
  Description of Artificial Sequence: Synthetic peptide
CSYAGGSTWV

SEQ ID NO: 631 - protein, 10 aa, Artificial Sequence
  Description of Artificial Sequence: Synthetic peptide
QQYHTWPPLT

SEQ ID NO: 632 - protein, 9 aa, Artificial Sequence
  Description of Artificial Sequence: Synthetic peptide
MQALQTPWT

SEQ ID NO: 633 - protein, 8 aa, Artificial Sequence
  Description of Artificial Sequence: Synthetic peptide
MQALQTQS

SEQ ID NO: 634 - protein, 11 aa, Artificial Sequence
  Description of Artificial Sequence: Synthetic peptide
DSRDSSGDHLV

SEQ ID NO: 635 - protein, 12 aa, Artificial Sequence
  Description of Artificial Sequence: Synthetic peptide
NSRDSSGNHPVV

SEQ ID NO: 636 - protein, 10 aa, Artificial Sequence
  Description of Artificial Sequence: Synthetic peptide
VSYRNFNSLV

SEQ ID NO: 637 - protein, 10 aa, Artificial Sequence
  Description of Artificial Sequence: Synthetic peptide
SSYTSSSTLV

SEQ ID NO: 638 - protein, 14 aa, Artificial Sequence
  Description of Artificial Sequence: Synthetic peptide
TGTSSDVGGYNYVS

SEQ ID NO: 639 - protein, 10 aa, Artificial Sequence
  Description of Artificial Sequence: Synthetic peptide
TSSDVGGYNY

SEQ ID NO: 640 - protein, 14 aa, Artificial Sequence
  Description of Artificial Sequence: Synthetic peptide
TGSRNDIGAYESVS

SEQ ID NO: 641 - protein, 14 aa, Artificial Sequence
  Description of Artificial Sequence: Synthetic peptide
TGSSSDVGGYNSVS

SEQ ID NO: 642 - protein, 14 aa, Artificial Sequence
  Description of Artificial Sequence: Synthetic peptide
TGSSSDIGGFNYVS

SEQ ID NO: 643 - protein, 14 aa, Artificial Sequence
  Description of Artificial Sequence: Synthetic peptide
TGTSSDIGGYNYVS

SEQ ID NO: 644 - protein, 14 aa, Artificial Sequence
  Description of Artificial Sequence: Synthetic peptide
TGTSSDVGGYNYVS

SEQ ID NO: 645 - protein, 14 aa, Artificial Sequence
  Description of Artificial Sequence: Synthetic peptide
TGTSSDVGGYNYVS

SEQ ID NO: 646 - protein, 14 aa, Artificial Sequence
  Description of Artificial Sequence: Synthetic peptide
TGTSSDVGGYNYVS

SEQ ID NO: 647 - protein, 14 aa, Artificial Sequence
  Description of Artificial Sequence: Synthetic peptide
TGTSSDVGGYNYVS

SEQ ID NO: 648 - protein, 14 aa, Artificial Sequence
  Description of Artificial Sequence: Synthetic peptide
TGTSSDVGGYNYVS

SEQ ID NO: 649 - protein, 7 aa, Artificial Sequence
  Description of Artificial Sequence: Synthetic peptide
EVNNRPS

SEQ ID NO: 650 - protein, 3 aa, Artificial Sequence
  Description of Artificial Sequence: Synthetic peptide
EVN

SEQ ID NO: 651 - protein, 7 aa, Artificial Sequence
  Description of Artificial Sequence: Synthetic peptide
GVNNRPS

SEQ ID NO: 652 - protein, 7 aa, Artificial Sequence
  Description of Artificial Sequence: Synthetic peptide
EVINRPS

SEQ ID NO: 653 - protein, 7 aa, Artificial Sequence
  Description of Artificial Sequence: Synthetic peptide
EVTNRPS

SEQ ID NO: 654 - protein, 7 aa, Artificial Sequence
  Description of Artificial Sequence: Synthetic peptide
EVSNRPS

SEQ ID NO: 655 - protein, 7 aa, Artificial Sequence
  Description of Artificial Sequence: Synthetic peptide
EVSNRPS

SEQ ID NO: 656 - protein, 7 aa, Artificial Sequence
  Description of Artificial Sequence: Synthetic peptide
DVSNRPS

SEQ ID NO: 657 - protein, 7 aa, Artificial Sequence
  Description of Artificial Sequence: Synthetic peptide
EVSNRPS

SEQ ID NO: 658 - protein, 7 aa, Artificial Sequence
  Description of Artificial Sequence: Synthetic peptide
DVSNRPS

SEQ ID NO: 659 - protein, 7 aa, Artificial Sequence
  Description of Artificial Sequence: Synthetic peptide
DVSNRPS

SEQ ID NO: 660 - protein, 11 aa, Artificial Sequence
  Description of Artificial Sequence: Synthetic peptide
SSYTSGRTLYV

SEQ ID NO: 661 - protein, 8 aa, Artificial Sequence
  Description of Artificial Sequence: Synthetic peptide
YTSGRTLY

SEQ ID NO: 662 - protein, 11 aa, Artificial Sequence
  Description of Artificial Sequence: Synthetic peptide
SSHTTTSTLYV

SEQ ID NO: 663 - protein, 10 aa, Artificial Sequence
  Description of Artificial Sequence: Synthetic peptide
SSYTSSSTYV

SEQ ID NO: 664 - protein, 11 aa, Artificial Sequence
  Description of Artificial Sequence: Synthetic peptide
SSYASGSPLYV

SEQ ID NO: 665 - protein, 11 aa, Artificial Sequence
  Description of Artificial Sequence: Synthetic peptide
SSYTSSSTLYV

SEQ ID NO: 666 - protein, 11 aa, Artificial Sequence
  Description of Artificial Sequence: Synthetic peptide
SSYTSSSTLYV

SEQ ID NO: 667 - protein, 11 aa, Artificial Sequence
  Description of Artificial Sequence: Synthetic peptide
SSYTSSSTLYV

SEQ ID NO: 668 - protein, 11 aa, Artificial Sequence
  Description of Artificial Sequence: Synthetic peptide
SSYTSSSTLYI

SEQ ID NO: 669 - protein, 11 aa, Artificial Sequence
  Description of Artificial Sequence: Synthetic peptide
SSYTSSSTLYV

SEQ ID NO: 670 - protein, 11 aa, Artificial Sequence
  Description of Artificial Sequence: Synthetic peptide
SSYTSSSTLYV

SEQ ID NO: 671 - protein, 127 aa, Artificial Sequence
  Description of Artificial Sequence: Synthetic polypeptide
EVQLQQSGPGLVKPSQTLSLTCAISGDSVSSNSAAWNWIRQSPSRGLEWLGRTYYRSKWYSDYAVSVKSRITINPDTSKNQFSLQLNSVTPEDTAVYYCARDPYDFWSGYPDAFDIWGQGTMVTVSS

SEQ ID NO: 672 - protein, 124 aa, Artificial Sequence
  Description of Artificial Sequence: Synthetic polypeptide
EVQLQQSGPGLVKPSQTLSLTCAISGDSVSNNNAAWNWIRQSPSRGLEWLGRTYHRSTWYNDYVGSVKSRITINPDTSKNQFSLQLNSVTPEDTAVYYCARETDYGDYGAFDIWGQGTTVTVSS

SEQ ID NO: 673 - protein, 121 aa, Artificial Sequence
  Description of Artificial Sequence: Synthetic polypeptide
EVQLQQSGPGLVNPSQTLSITCAISGDSVSSNSAAWNWIRQSPSRGLEWLGRTFYRSKWYNDYAVSVKGRITISPDTSKNQFSLQLNSVTPEDTAVYYCAGGDYYYGLDVWGQGTTVTVSS

SEQ ID NO: 674 - protein, 127 aa, Artificial Sequence
  Description of Artificial Sequence: Synthetic polypeptide
EVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSS

SEQ ID NO: 675 - protein, 127 aa, Artificial Sequence; identical to SEQ ID NO: 674
  Description of Artificial Sequence: Synthetic polypeptide

SEQ ID NO: 676 - protein, 127 aa, Artificial Sequence
  Description of Artificial Sequence: Synthetic polypeptide
QVQLQESGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSS

SEQ ID NO: 677 - protein, 127 aa, Artificial Sequence; identical to SEQ ID NO: 674
  Description of Artificial Sequence: Synthetic polypeptide

SEQ ID NO: 678 - protein, 127 aa, Artificial Sequence; identical to SEQ ID NO: 674
  Description of Artificial Sequence: Synthetic polypeptide

SEQ ID NO: 679 - protein, 127 aa, Artificial Sequence
  Description of Artificial Sequence: Synthetic polypeptide
EVQLQQSGPGLVKPSQTLPLTCAISGDSVLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSS

SEQ ID NO: 680 - protein, 127 aa, Artificial Sequence
  Description of Artificial Sequence: Synthetic polypeptide
EVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSS

SEQ ID NO: 681 - protein, 112 aa, Artificial Sequence
  Description of Artificial Sequence: Synthetic polypeptide
QSALTQPASVSGSPGQSITISCTGTSSDVGGYNYVSWYQQHPGKAPKVIISEVNNRPSGVSHRFSGSKSGNTASLTISGLQAEDEADYFCSSYTSGRTLYVFGTGSKVTVLG

SEQ ID NO: 682 - protein, 112 aa, Artificial Sequence
  Description of Artificial Sequence: Synthetic polypeptide
QSALTQPASVSGSPGQSITISCTGSRNDIGAYESVSWYQQHPGNAPKLIIHGVNNRPSGVFDRFSVSQSGNTASLTISGLQAEDEADYYCSSHTTTSTLYVFGTGTKVTVLG

SEQ ID NO: 683 - protein, 111 aa, Artificial Sequence
  Description of Artificial Sequence: Synthetic polypeptide
QSALTQPASVSGSPGQSITISCTGSSSDVGGYNSVSWYQQHPGKAPKLMIYEVINRPSGVSHRFSGSKSGNTASLTISGLQAEDEADYYCSSYTSSSTYVFGTGTKVTVLG

SEQ ID NO: 684 - protein, 112 aa, Artificial Sequence
  Description of Artificial Sequence: Synthetic polypeptide
QSALTQPASVSGSPGQSITISCTGSSSDIGGFNYVSWYQQHAGEAPKLMIYEVTNRPSGVSDRFSGSKSDNTASLTISGLQAEDEADYYCSSYASGSPLYVFGTGTKVTVLG

SEQ ID NO: 685 - protein, 112 aa, Artificial Sequence
  Description of Artificial Sequence: Synthetic polypeptide
QSALTQPASVSGSPGQSITFSCTGTSSDIGGYNYVSWYQQHPGKAPKLMIYEVSNRPSGVSNRFSGTKSGNTASLTISGLQAEDEADYYCSSYTSSSTLYVFGTGTKLTVLG

SEQ ID NO: 686 - protein, 112 aa, Artificial Sequence
  Description of Artificial Sequence: Synthetic polypeptide
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLYVFGTGTKVTVLG

SEQ ID NO: 687 - protein, 112 aa, Artificial Sequence
  Description of Artificial Sequence: Synthetic polypeptide
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLYVFGTGTKVTVLG

SEQ ID NO: 688 - protein, 112 aa, Artificial Sequence
  Description of Artificial Sequence: Synthetic polypeptide
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLYIFGTGTKVTVLG

SEQ ID NO: 689 - protein, 111 aa, Artificial Sequence
  Description of Artificial Sequence: Synthetic polypeptide
QSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVL

SEQ ID NO: 690 - protein, 111 aa, Artificial Sequence; identical to SEQ ID NO: 689
  Description of Artificial Sequence: Synthetic polypeptide

SEQ ID NO: 691 - protein, 251 aa, Artificial Sequence
  Description of Artificial Sequence: Synthetic polypeptide
QVQLVESGGGVVQPGRSLRLSCAASGFTFRDYYMAWVRQAPGKGLEWVASISYEGNPYYGDSVKGRFTISRDNAKSTLYLQMSSLRAEDTAVYYCARHDHNNVDWFAYWGQGTLVTVSSGGGGSGGGGSGGGGSGGGGSDIVMTQTPLSLSVTPGQPVSMSCKSSQSLLYSENKKNYLAWYLQKPGQSPQLLIFWASTRESGVPDRFSGSGSGTDFTLKISRVEAEDVGVYYCQQYYNFPTFGQGTKLEIK

SEQ ID NO: 692 - protein, 251 aa, Artificial Sequence
  Description of Artificial Sequence: Synthetic polypeptide
QVQLVQSGAEVKKPGASVKVSCKASGFTFRDYYMAWVRQAPGQRLEWMGSISYEGNPYYGDSVKGRVTITRDNSASTLYMELSSLRSEDTAVYYCARHDHNNVDWFAYWGQGTLVTVSSGGGGSGGGGSGGGGSGGGGSDIQMTQSPSSLSASVGDRVTITCKSSQSLLYSENKKNYLAWYQQKPGKVPKLLIFWASTRESGVPSRFSGSGSGTDFTLTISSLQPEDVATYYCQQYYNFPTFGQGTKLEIK

SEQ ID NO: 693 - protein, 251 aa, Artificial Sequence
  Description of Artificial Sequence: Synthetic polypeptide
EVQLVQSGAEVKKPGESLKISCKGSGFTFRDYYMAWVRQMPGKGLEWMGSISYEGNPYYGDSVKGQVTISRDNSISTLYLQWSSLKASDTAMYYCARHDHNNVDWFAYWGQGTLVTVSSGGGGSGGGGSGGGGSGGGGSEIVMTQSPATLSLSPGERATLSCKSSQSLLYSENKKNYLAWYQQKPGQAPRLLIFWASTRESGIPARFSGSGSGTDFTLTISSLQPEDLAVYYCQQYYNFPTFGQGTKLEIK

SEQ ID NO: 694 - protein, 251 aa, Artificial Sequence
  Description of Artificial Sequence: Synthetic polypeptide
EVQLVQSGAEVKKPGESLKISCKGSGFTFRDYYMAWVRQMPGKGLEWMGSISYEGNPYYGDSVKGQVTISRDNSISTLYLQWSSLKASDTAMYYCARHDHNNVDWFAYWGQGTLVTVSSGGGGSGGGGSGGGGSGGGGSDIQMTQSPSSLSASVGDRVTITCKSSQSLLYSENKKNYLAWYQQKPGKVPKLLIFWASTRESGVPSRFSGSGSGTDFTLTISSLQPEDVATYYCQQYYNFPTFGQGTKLEIK

SEQ ID NO: 695 - protein, 251 aa, Artificial Sequence
  Description of Artificial Sequence: Synthetic polypeptide
QVQLVQSGAEVKKPGASVKVSCKASGFTFRDYYMAWVRQAPGQGLEWMGSISYEGNPYYGDSVKGRVTMTRDNSTSTLYMELSSLRSEDTAVYYCARHDHNNVDWFAYWGQGTLVTVSSGGGGSGGGGSGGGGSGGGGSEIVMTQSPATLSLSPGERATLSCKSSQSLLYSENKKNYLAWYQQKPGQAPRLLIFWASTRESGIPARFSGSGSGTDFTLTISSLQPEDLAVYYCQQYYNFPTFGQGTKLEIK

SEQ ID NO: 696 - protein, 251 aa, Artificial Sequence
  Description of Artificial Sequence: Synthetic polypeptide
QVQLVQSGAEVKKPGASVKVSCKASGFTFRDYYMAWVRQAPGQGLEWMGSISYEGNPYYGDSVKGRVTMTRDNSTSTLYMELSSLRSEDTAVYYCARHDHNNVDWFAYWGQGTLVTVSSGGGGSGGGGSGGGGSGGGGSDIQMTQSPSSLSASVGDRVTITCKSSQSLLYSENKKNYLAWYQQKPGKVPKLLIFWASTRESGVPSRFSGSGSGTDFTLTISSLQPEDVATYYCQQYYNFPTFGQGTKLEIK

SEQ ID NO: 697 - protein, 10 aa, Artificial Sequence
  Description of Artificial Sequence: Synthetic peptide
EYTFTDYAFH

SEQ ID NO: 698 - protein, 10 aa, Artificial Sequence
  Description of Artificial Sequence: Synthetic peptide
GFTFSKYGMN

SEQ ID NO: 699 - protein, 10 aa, Artificial Sequence
  Description of Artificial Sequence: Synthetic peptide
GFTFRDYYMA

SEQ ID NO: 700 - protein, 122 aa, Artificial Sequence
  Description of Artificial Sequence: Synthetic polypeptide
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTV

SEQ ID NO: 701 - protein, 124 aa, Artificial Sequence
  Description of Artificial Sequence: Synthetic polypeptide
QVQLVQSGGGLIQPGGSLRLSCAASGFTVSSNYMSWVRQAPGKGLEWVSVIYSGGSTYYADSVKGRFTISRDNSKNTLYLQMNSLRAEDTAVYYCASQSTPYDSSGYYSGDAFDIWGQGTMVTV

SEQ ID NO: 702 - protein, 123 aa, Artificial Sequence
  Description of Artificial Sequence: Synthetic polypeptide
EVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARDLGWIAVAGTFDYWGQGTLVTV

SEQ ID NO: 703 - protein, 125 aa, Artificial Sequence
  Description of Artificial Sequence: Synthetic polypeptide
EVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGAYYCARDRLQDGNSWSDAFDVWGQGTMVTV

SEQ ID NO: 704 - protein, 120 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKGLSSWHFHDALDIWGQGTMVTV

SEQ ID NO: 705 - protein, 122 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDKGGGYYDFWSGSDYWGQGTLVTV

SEQ ID NO: 706 - protein, 119 aa, Artificial Sequence
  Description of Artificial Sequence: Synthetic polypeptide
EVQLQQSGPGLVKPSLTLSLTCAISGDSVSSNSATWTWIRQSPSRGLEWLGRTYYRSTWYNDYAVSVKSRITINPDTSKNQFSLQLNSVTPEDTAVYYCAREGSGSYYAYWGQGTLVTV

SEQ ID NO: 707 - protein, 120 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDYWGYYGSGTLDYWGQGTLVTV

SEQ ID NO: 708 - protein, 126 aa, Artificial Sequence
  Description of Artificial Sequence: Synthetic polypeptide
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARAGLALYSNYVPYYYYGMDVWGQGTTVTV

SEQ ID NO: 709 - protein, 114 aa, Artificial Sequence
  Description of Artificial Sequence: Synthetic polypeptide
EVQLVESGGGLVKPGGSLRLSCVASGFTFSNAWMNWVRQAPGKGLEWVGRIKSKTDGGTADYAAPVKGRFTISRDDSKNTMYLQMNSLKTEDTGVYYCITGATDVWGQGTTVTV

SEQ ID NO: 710 - protein, 125 aa, Artificial Sequence
  Description of Artificial Sequence: Synthetic polypeptide
EVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTV

SEQ ID NO: 711 - protein, 125 aa, Artificial Sequence
  Description of Artificial Sequence: Synthetic polypeptide
EVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREESSSGWYEGNWFDPWGQGTLVTV

SEQ ID NO: 712 - protein, 125 aa, Artificial Sequence; identical to SEQ ID NO: 710
  Description of Artificial Sequence: Synthetic polypeptide

SEQ ID NO: 713 - protein, 118 aa, Artificial Sequence
  Description of Artificial Sequence: Synthetic polypeptide
QVQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARGRMDTAMAQIWGQGTMVTV

SEQ ID NO: 714 - protein, 115 aa, Artificial Sequence
  Description of Artificial Sequence: Synthetic polypeptide
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDLDVSLDIWGQGTMVTV

SEQ ID NO: 715 - protein, 121 aa, Artificial Sequence
  Description of Artificial Sequence: Synthetic polypeptide
EVQLVESGGGLVQPGGSLRLSCAASGFTFSSYAMHWVRQAPGKGLEYVSAISSNGGSTYYANSVKDRFTISRDNSKNTLYLQMGSLRAEDMAVYYCARVHSSGYYHPGPNDYWGQGTLVTV

SEQ ID NO: 716 - protein, 116 aa, Artificial Sequence
  Description of Artificial Sequence: Synthetic polypeptide
EVQLVESGAEVKKPGASVKVSCKASGYTFTSYYMHWVRQAPGQGLEWMGIINPSGGSTSYAQKFQGRVTMTRDTSTSTAYMELSSLRSEDTAVYYCAREAGVVAVDYWGQGTLVTV

SEQ ID NO: 717 - protein, 120 aa, Artificial Sequence
  Description of Artificial Sequence: Synthetic polypeptide
QVQLVQSGGGVVQPGRSLRLSCAASGFTFSSYAMSWVRQAPGKGLEWVSAISGSGGSTYYADSVKGRFTISRDNSKNTLYLQMNSLRAEDTAVYYCAKEPLFGVVEEDVDYWGQGTLVTV

SEQ ID NO: 718 - protein, 118 aa, Artificial Sequence
  Description of Artificial Sequence: Synthetic polypeptide
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARGSGSLGDAFDIWGQGTMVTV

SEQ ID NO: 719 - protein, 119 aa, Artificial Sequence
  Description of Artificial Sequence: Synthetic polypeptide
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDGFGELSGAFDIWGQGTMVTV

SEQ ID NO: 720 - protein, 120 aa, Artificial Sequence
  Description of Artificial Sequence: Synthetic polypeptide
EVQLVESGAEVKKPGASVKVSCKASGYTFTSYYMHWVRQAPGQGLEWMGIINPSGGSTSYAQKFQGRVTMTRDTSTSTVYMELSSLRSEDTAVYYCARGPIGCSGGSCLDYWGQGTLVTV

SEQ ID NO: 721 - protein, 119 aa, Artificial Sequence
  Description of Artificial Sequence: Synthetic polypeptide
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARGSYGDYGDAFDIWGQGTTVTV

SEQ ID NO: 722 - protein, 116 aa, Artificial Sequence
  Description of Artificial Sequence: Synthetic polypeptide
EVQLVESGAEVKKPGSSVKVSCKASGGTFSSYAISWVRQAPGQGLEWMGGIIPIFGTANYAQKFQGRVTITADESTSTAYMELSSLRSEDTAVYYCARDHKVVRFGYWGQGTLVTV

SEQ ID NO: 723 - protein, 114 aa, Artificial Sequence
  Description of Artificial Sequence: Synthetic polypeptide
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARGDYYMDVWGKGTTVTV

SEQ ID NO: 724 - protein, 122 aa, Artificial Sequence
  Description of Artificial Sequence: Synthetic polypeptide
EVQLVESGGGLVQPGGSLRLSCAASGFTFSSYAMSWVRQAPGKGLEWVSYISSSSSTIYYADSVKGRFTISRDNAKNSLYLQMNSLRAEDTAVYYCARDGPIRYFDHSKAFDIWGQGTMVTV

SEQ ID NO: 725 - protein, 117 aa, Artificial Sequence
  Description of Artificial Sequence: Synthetic polypeptide
QVQLVQSGAEVKKPGASVKVSCKASGYTFTSYYMHWVRQAPGQGLEWMGIINPSGGSTSYAQKFQGRVTMTRDTSISTAYMELSRLRSDDTAVYYCAREMDDSSGPDYWGQGTLVTV

SEQ ID NO: 726 - protein, 121 aa, Artificial Sequence
  Description of Artificial Sequence: Synthetic polypeptide
EVQLVESGAEVKKPGESLKISCKGSGYSFTGSWIGWGRQMPGKGLEWMGIIYPGDSDTRYSPSFQGQVTISADKSISTAYLQWSSLKASDTAMYYCARGFLRGGDCCGALDIWGQGTMVTV

SEQ ID NO: 727 - protein, 119 aa, Artificial Sequence
  Description of Artificial Sequence: Synthetic polypeptide
QVQLQESGPGLVKPSETLSLTCSVSGGSINSYYWSWIRQAPGKGLEWIAFTSHSGNVKYNPSLTGRVTIAVDTSKNQFYLEVTSVTAADTAVYFCARGLDPLFAYDAFEIWGLGTMVTV

SEQ ID NO: 728 - protein, 117 aa, Artificial Sequence
  Description of Artificial Sequence: Synthetic polypeptide
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDDFWSGSVDYWGQGTLVTV

SEQ ID NO: 729 - protein, 120 aa, Artificial Sequence
  Description of Artificial Sequence: Synthetic polypeptide
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREDDSSGYTSPFDYWGQGTLVTV

SEQ ID NO: 730 - protein, 123 aa, Artificial Sequence
  Description of Artificial Sequence: Synthetic polypeptide
EVQLVESGAEVKKPGASVKVSCKASGYTFTGYYMHWVRQAPGQGLEWMGWINPNSGGTNYAQKFQGRVTMTRDTSISTAYMELSRLRSDDTAVYYCAREPASSSWYGYYYYMDVWGKGTLVTV

SEQ ID NO: 731 - protein, 120 aa, Artificial Sequence
  Description of Artificial Sequence: Synthetic polypeptide
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGDSNYWSYYGMDVWGQGTLVTV

SEQ ID NO: 732 - protein, 116 aa, Artificial Sequence
  Description of Artificial Sequence: Synthetic polypeptide
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCASFSSSDSYDYWGQGTLVTV

SEQ ID NO: 733 - protein, 125 aa, Artificial Sequence
  Description of Artificial Sequence: Synthetic polypeptide
QVNLRESGPALVKPTQTLTLTCTFSGFSLNTFGMSVSWIRQPPGKALEWLALIDWDDDKYYSTSLRTRLTISKDTAKNQVVLRMTNMDPMDTATYYCARIYGGDRTNTQAPYFFDLWGQGTLVTV

SEQ ID NO: 734 - protein, 120 aa, Artificial Sequence
  Description of Artificial Sequence: Synthetic polypeptide
QVQLQESGPGLVKPSGTLSLTCAVSGASITSRHWWNWVRHSPGKGLEWIGQIYHSGTTTYNPSLGSRVTISVDKSKNQISLELRSVTAADTATYYCVRDYLELATYYGMDVWGQGTTVTV

SEQ ID NO: 735 - protein, 122 aa, Artificial Sequence
  Description of Artificial Sequence: Synthetic polypeptide
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDLAAAGNYYYYGMDVWGQGTTVTV

SEQ ID NO: 736 - protein, 120 aa, Artificial Sequence
  Description of Artificial Sequence: Synthetic polypeptide
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDDDFWSGSGAFDIWGQGTTVTV

SEQ ID NO: 737 - protein, 121 aa, Artificial Sequence
  Description of Artificial Sequence: Synthetic polypeptide
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARPEGVSYYDSSVLDYWGQGTLVTV

SEQ ID NO: 738 - protein, 119 aa, Artificial Sequence
  Description of Artificial Sequence: Synthetic polypeptide
QVQLVQSGAEVKKPGASVKVSCKASGYTFTSYYMHWVRQAPGQGLEWMGIINPSGGSTSYAQKFQGRVTMTRDTSTSTVYMELSSLRAEDTAVYYCARGGYGDYLDAFDIWGQGTTVTV

SEQ ID NO: 739 - protein, 107 aa, Artificial Sequence
  Description of Artificial Sequence: Synthetic polypeptide
DIQMTQSPSSLSASVGDRVTITCRASQTIWSYLNWYQQRPGKAPNLLIYAASSLQSGVPSRFSGRGSGTDFTLTISSLQAEDFATYYCQQSYSIPQTFGQGTKLEIK

SEQ ID NO: 740 - protein, 110 aa, Artificial Sequence
  Description of Artificial Sequence: Synthetic polypeptide
SYVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGYVFGTGTKLTVL

SEQ ID NO: 741 - protein, 111 aa, Artificial Sequence
  Description of Artificial Sequence: Synthetic polypeptide
QSALTQPASVSGSPGQSITISCTGTSSDVGGYNYVSWYQQHPGKAPKLMIYDVSKRPSGVSNRFSGSKSGNTASLTISGLQAEDEADYYCSSYTSSSLNHVFGTGTKVTVL

SEQ ID NO: 742 - protein, 111 aa, Artificial Sequence
  Description of Artificial Sequence: Synthetic polypeptide
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTPYVFGTGTQLTVL

SEQ ID NO: 743 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDSSGNHLWVFGGGTKLTVL

SEQ ID NO: 744 - protein, 106 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDSSGWVFGGGTKLTVL

SEQ ID NO: 745 - protein, 111 aa, Artificial Sequence
  Description of Artificial Sequence: Synthetic polypeptide
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLYVFGTGTKVTVL

SEQ ID NO: 746 - protein, 110 aa, Artificial Sequence
  Description of Artificial Sequence: Synthetic polypeptide
QSALTQPGSVSGSPGQSITISCTGTSSDVGGYNYVSWYQQHPGKAPKLIIYDVSSRPSGVSNRFSGSQSGNTASLTISGLQAEDEADYSCSSYAGSNTLVFGTGTKVTVL

SEQ ID NO: 747 - protein, 111 aa, Artificial Sequence
  Description of Artificial Sequence: Synthetic polypeptide
NFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSNPWVFGGGTKLTVL

SEQ ID NO: 748 - protein, 110 aa, Artificial Sequence
  Description of Artificial Sequence: Synthetic polypeptide
SYVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGPVFGGGTKLTVL

SEQ ID NO: 749 - protein, 112 aa, Artificial Sequence
  Description of Artificial Sequence: Synthetic polypeptide
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLVYVFGTGTKVTVL

SEQ ID NO: 750 - protein, 107 aa, Artificial Sequence
  Description of Artificial Sequence: Synthetic polypeptide
SSELTQDPAVSVALGQTVRITCQGDSLRSYYASWYQQKPGQAPVLVIYGKNHRPSGIPDRFSGSSSGDTDSLTITGAQAEDEADYYCHSRDSSGNHLFGGGTKLTVL

SEQ ID NO: 751 - protein, 111 aa, Artificial Sequence; identical to SEQ ID NO: 689
  Description of Artificial Sequence: Synthetic polypeptide

SEQ ID NO: 752 - protein, 110 aa, Artificial Sequence
  Description of Artificial Sequence: Synthetic polypeptide
NFMLTQPHSVSESPGKTVTIPCTGSSGSFASSYVQWYQQRPGSAPATVIYEDNQRPSGVPDRFSGSVDSSSNSASLTISGLKTEDEAVYYCQSYDGATWVFGGGTKLTVL

SEQ ID NO: 753 - protein, 110 aa, Artificial Sequence
  Description of Artificial Sequence: Synthetic polypeptide
QSALTQPASVSGSPGQSITISCSGTSSDVGGYNSVSWYQQYPGKAPKLMIYDVNNRPSGVSSRFSGSKSGNTASLTISGLQAEDEADYYCSSYTSSSTLFFGAGTKVTVL

SEQ ID NO: 754 - protein, 109 aa, Artificial Sequence
  Description of Artificial Sequence: Synthetic polypeptide
SSELTQDPAVSVALGQTVRITCQGDSLRTYYATWYQQKPGQAPVLVFYDENNRPSGIPDRFSGSSSGNTASLTITGTQAEDEADYYCSSRDSSGNPSCVFGGGTKLTVL

SEQ ID NO: 755 - protein, 110 aa, Artificial Sequence
  Description of Artificial Sequence: Synthetic polypeptide
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTWVFGGGTKLTVL

SEQ ID NO: 756 - protein, 113 aa, Artificial Sequence
  Description of Artificial Sequence: Synthetic polypeptide
DVVMTQSPLSLPVTPGEPASISCRSSQSLLAGNGHNYLDWYLQKPGQSPQLLIYLGSNRASGVPDRFSGSGSGTDFTLKISRVEAEDVGVYYCMQALQNPLTFGGGTKLEIKR

SEQ ID NO: 757 - protein, 110 aa, Artificial Sequence
  Description of Artificial Sequence: Synthetic polypeptide
QSALTQPASVSGSPGQSITISCTGSSSDVGGYNYVSWYQQHPGKAPKLMIYEVSNRPSGVSNRFSGSKSGNTASLTISGLQAEDEADYYCSSYTSSSTLVFGTGTKVTVL

SEQ ID NO: 758 - protein, 110 aa, Artificial Sequence
  Description of Artificial Sequence: Synthetic polypeptide
QSALTQPASVSGSPGQSITISCTGTSSDVGGYNYVSWYQQHPGKAPKLMIYDVSNRPSGVSNRFSGSKSGNTASLTISGLQAEDEADYYCSSYASSSTLVFGGGTKVTVL

SEQ ID NO: 759 - protein, 110 aa, Artificial Sequence
  Description of Artificial Sequence: Synthetic polypeptide
QSALTQPAYVSGSPGQSITISCTGTNSDVGRYNYVSWYQQHPGKAPKLMIYEVSYRPSGVSNRFSGSKSGNTASLTISGLQAEDEADYYCSSYTTSSTLDFGTGTKVTVL

SEQ ID NO: 760 - protein, 110 aa, Artificial Sequence
  Description of Artificial Sequence: Synthetic polypeptide
QSALTQPASVSGSPGQSITISCTGTSSDVGGYKYVSWYQQHPGKAPKLMIYDVSNRPSGVSNRFSGSKSGNTASLTISGLQAEDEADYYCSSYTSSSTLVFGGGTKLTVL

SEQ ID NO: 761 - protein, 111 aa, Artificial Sequence
  Description of Artificial Sequence: Synthetic polypeptide
HVILTQPPSASASLGASVKLTCTLSSGHSSYAIAWHQQQPEKGPRYLMKVNSDGSLSKGDGIPDRFSGSTSGAERYLTISSLQSEDEADYYCQTWGSGMAIFGGGTKLTVL

SEQ ID NO: 762 - protein, 110 aa, Artificial Sequence
  Description of Artificial Sequence: Synthetic polypeptide
QSALTQPASASGSPGQSVTISCTGTSSDVGGYNYVSWYQQHPGKAPKLMIYEVSKRPSGVPDRFSGSKSGNTASLTISGLQAEDEADYYCSSYTSSGTLVFGGGTKLTVL

SEQ ID NO: 763 - protein, 108 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYRNSRDSSGNPYVFGTGTKVTVL

SEQ ID NO: 764 - protein, 110 aa, Artificial Sequence
  Description of Artificial Sequence: Synthetic polypeptide
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLVFGTGTKLTVL

SEQ ID NO: 765 - protein, 114 aa, Artificial Sequence
  Description of Artificial Sequence: Synthetic polypeptide
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPPWTFGQGTKLEIKR

SEQ ID NO: 766 - protein, 114 aa, Artificial Sequence
  Description of Artificial Sequence: Synthetic polypeptide
EIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQVLQTPPLTFGGGTKVDIKR

SEQ ID NO: 767 - protein, 108 aa, Artificial Sequence
  Description of Artificial Sequence: Synthetic polypeptide
SYVLTQPPSVSVAPGKTATITCGGTNIGSKNVHWYQQKPGQAPVLAIYYDSDRPSGIPERFSGSNSGNTATLTISRVEAGDEADYFCQVWDSSSDHWVFGGGTKLTVL

SEQ ID NO: 768 - protein, 108 aa, Artificial Sequence
  Description of Artificial Sequence: Synthetic polypeptide
SYELTQPPSVSVAPGETASIACGGHNIRSKNVHWYQQKPGQAPVLVISYDGDRPSGIPERFSGSNLGSTATLTISRVEAGDEADYYCQVWDSDSDHYVFGTGTKVTVL

SEQ ID NO: 769 - protein, 107 aa, Artificial Sequence
  Description of Artificial Sequence: Synthetic polypeptide
DIQMTQSPSSLSASVGDRVTITCRASQSINTYLNWYQQKPGKPPKLLIYAASNLQSGVPSRFSGSGSGTHFTLTISSLQPDDFATYYCQQSYSSLLTFGGGTKLEIK

SEQ ID NO: 770 - protein, 110 aa, Artificial Sequence
  Description of Artificial Sequence: Synthetic polypeptide
QSVLTQPRSVSGSPGQSVTISCTGTSSDVGGYNYVSWYQQHPGEAPKLIIYDADKRPSGISNRFSSGKSGNTASLTISGLQVEDEADYYCCSYAGGSTWVFGGGTKVTVL

SEQ ID NO: 771 - protein, 109 aa, Artificial Sequence
  Description of Artificial Sequence: Synthetic polypeptide
EIVLTQSPATLSVSPGERATLSCRASQSVTSNLAWYQQKPGQAPRLLIYAASTRATGIPARFSGSGSGTEFTLTISSMQSEDFAVYFCQQYHTWPPLTFGGGTKVEIKT

SEQ ID NO: 772 - protein, 112 aa, Artificial Sequence
  Description of Artificial Sequence: Synthetic polypeptide
DVVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKLEIK

SEQ ID NO: 773 - protein, 111 aa, Artificial Sequence
  Description of Artificial Sequence: Synthetic polypeptide
EIVLTQSPLSLPVTPGEPASISCRSSQSLLYSDGYNYLDWYLQKPGQSPQLLIYLGSNRASGVPDRFSGSGSGTDFTLQISGVETEDVGVYYCMQALQTQSFGQGTKLEIK

SEQ ID NO: 774 - protein, 108 aa, Artificial Sequence
  Description of Artificial Sequence: Synthetic polypeptide
SSELTQDPAVSVALGQTARITCQGDSLRSYFTSWYHQKPGQAPVLVIYGNNNRPSGIPDRFSGSSSGNTASLTITGAQAEDEGDYYCDSRDSSGDHLVFGGGTKLTVL

SEQ ID NO: 775 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDSSGNHPVVFGGGTKLTVL

SEQ ID NO: 776 - protein, 110 aa, Artificial Sequence
  Description of Artificial Sequence: Synthetic polypeptide
QSALTQPASVSGSPGQSITISCTGTSSDVGGYKHVSWYQHHPGKAPKLMIYDVSNRPSGVSNRFSGSKSGNTASLTVSGLQAEDEAHYYCVSYRNFNSLVFGTGTKVTVL

SEQ ID NO: 777 - protein, 110 aa, Artificial Sequence
  Description of Artificial Sequence: Synthetic polypeptide
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLVFGTGTQLTVL

SEQ ID NO: 778 - protein, 12 aa, Artificial Sequence
  Description of Artificial Sequence: Synthetic peptide
RFSLSTYGMSVG

SEQ ID NO: 779 - protein, 10 aa, Artificial Sequence
  Description of Artificial Sequence: Synthetic peptide
GFTFSSSGMQ

SEQ ID NO: 780 - protein, 12 aa, Artificial Sequence
  Description of Artificial Sequence: Synthetic peptide
GFSLNTHGMGVG

SEQ ID NO: 781 - protein, 12 aa, Artificial Sequence
  Description of Artificial Sequence: Synthetic peptide
GFSLSTSGMVVS

SEQ ID NO: 782 - protein, 10 aa, Artificial Sequence
  Description of Artificial Sequence: Synthetic peptide
GNTVTGYAMH

SEQ ID NO: 783 - protein, 10 aa, Artificial Sequence
  Description of Artificial Sequence: Synthetic peptide
GFTFRDYYMA

SEQ ID NO: 784 - protein, 10 aa, Artificial Sequence
  Description of Artificial Sequence: Synthetic peptide
GFTFSSSGMQ

SEQ ID NO: 785 - protein, 10 aa, Artificial Sequence
  Description of Artificial Sequence: Synthetic peptide
EYTFTDYAFH

SEQ ID NO: 786 - protein, 10 aa, Artificial Sequence
  Description of Artificial Sequence: Synthetic peptide
GFTFSKYGMN

SEQ ID NO: 787 - protein, 12 aa, Artificial Sequence
  Description of Artificial Sequence: Synthetic peptide
RFSLSTYGMSVG

SEQ ID NO: 788 - protein, 12 aa, Artificial Sequence
  Description of Artificial Sequence: Synthetic peptide
GFSLNTHGMGVG

SEQ ID NO: 789 - protein, 12 aa, Artificial Sequence
  Description of Artificial Sequence: Synthetic peptide
GFSLSTSGMVVS

SEQ ID NO: 790 - protein, 10 aa, Artificial Sequence
  Description of Artificial Sequence: Synthetic peptide
GNTVTGYAMH

SEQ ID NO: 791 - protein, 17 aa, Artificial Sequence
  Description of Artificial Sequence: Synthetic peptide
WINTYSGKPTYADDFKG

SEQ ID NO: 792 - protein, 17 aa, Artificial Sequence
  Description of Artificial Sequence: Synthetic peptide
SISSTSIYIYYADTVKG

SEQ ID NO: 793 - protein, 16 aa, Artificial Sequence
  Description of Artificial Sequence: Synthetic peptide
SISYEGNPYYGDSVKG

SEQ ID NO: 794 - protein, 16 aa, Artificial Sequence
  Description of Artificial Sequence: Synthetic peptide
DIWWDDDKHYNPSLKN

SEQ ID NO: 795 - protein, 17 aa, Artificial Sequence
  Description of Artificial Sequence: Synthetic peptide
GIYYDSYKKSYADSVKG

SEQ ID NO: 796 - protein, 16 aa, Artificial Sequence
  Description of Artificial Sequence: Synthetic peptide
NIWWDDDKYYNPSLKN

SEQ ID NO: 797 - protein, 16 aa, Artificial Sequence
  Description of Artificial Sequence: Synthetic peptide
AIAWDGDKYYNPSLKS

SEQ ID NO: 798 - protein, 17 aa, Artificial Sequence
  Description of Artificial Sequence: Synthetic peptide
WINTYSGKPTYADDFKG

SEQ ID NO: 799 - protein, 16 aa, Artificial Sequence
  Description of Artificial Sequence: Synthetic peptide
SISYEGNPYYGDSVKG

SEQ ID NO: 800 - protein, 255 aa, Artificial Sequence
  Description of Artificial Sequence: Synthetic polypeptide
QIQLVQSGPELKKPGESVKISCKTSEYTFTDYAFHWVKQAPGKGLKWMGWINTYSGKPTYADDFKGRFVFSLEDSARTANLQISNLKNEDTATYFCARGAYYGYRDWFTYWGQGTLVTVSSGGGGSGGGGSGGGGSGGGGSDIVMTQTPSSQAVSAGEKVTMSCKSSQSLLYSENKKNYLAWYQQKPGQSPKLLIYWASTRESGVPDRFIGSGSGTDFTLTISSVQAEDLAVYYCQQYYNFPPWTFGGGTKLELK

SEQ ID NO: 801 - DNA, 765 bp, Artificial Sequence
  Description of Artificial Sequence: Synthetic polynucleotide
caaattcaactggtccagtccggccctgagctgaagaagccgggagaatccgtgaagatctcctgcaagacctcggagtacaccttcactgactacgccttccactgggtcaagcaggcacctgggaaaggcctgaagtggatgggctggatcaacacttactcggggaagccaacctacgccgatgatttcaagggaagattcgtgtttagcctggaggactccgcccggacagctaacctccaaatctccaaccttaagaacgaggacactgcgacctacttctgcgcgcggggagcctattacggttatcgcgactggttcacctactggggacagggcaccctcgtgaccgtgtcctccggcggtggaggctcaggggggggcggctcgggagggggtggaagcggaggaggaggctccgatattgtgatgacccagaccccgtcgagccaggcagtgtccgctggagaaaaggtcaccatgtcctgcaagagctcacagtccctgttgtactccgaaaacaagaagaattacctggcctggtaccagcagaagcccggacagtcccctaaactgctgatctactgggcctcgactagggaatctggcgtgcccgaccgctttatcggaagcggttcagggactgacttcaccctgaccattagcagcgtgcaggccgaggacctggcggtgtactactgtcaacagtactacaacttcccgccctggactttcggcggtggaacgaagctcgaactcaag

SEQ ID NO: 802 - DNA, 858 bp, Artificial Sequence
  Description of Artificial Sequence: Synthetic polynucleotide
atggccctccctgtcaccgccctgctgcttccgctggctcttctgctccacgccgctcggccccaaattcaactggtccagtccggccctgagctgaagaagccgggagaatccgtgaagatctcctgcaagacctcggagtacaccttcactgactacgccttccactgggtcaagcaggcacctgggaaaggcctgaagtggatgggctggatcaacacttactcggggaagccaacctacgccgatgatttcaagggaagattcgtgtttagcctggaggactccgcccggacagctaacctccaaatctccaaccttaagaacgaggacactgcgacctacttctgcgcgcggggagcctattacggttatcgcgactggttcacctactggggacagggcaccctcgtgaccgtgtcctccggcggtggaggctcaggggggggcggctcgggagggggtggaagcggaggaggaggctccgatattgtgatgacccagaccccgtcgagccaggcagtgtccgctggagaaaaggtcaccatgtcctgcaagagctcacagtccctgttgtactccgaaaacaagaagaattacctggcctggtaccagcagaagcccggacagtcccctaaactgctgatctactgggcctcgactagggaatctggcgtgcccgaccgctttatcggaagcggttcagggactgacttcaccctgaccattagcagcgtgcaggccgaggacctggcggtgtactactgtcaacagtactacaacttcccgccctggactttcggcggtggaacgaagctcgaactcaagggatcgcaccaccatcaccatcatcatcac

SEQ ID NO: 803 - protein, 286 aa, Artificial Sequence
  Description of Artificial Sequence: Synthetic polypeptide
MALPVTALLLPLALLLHAARPQIQLVQSGPELKKPGESVKISCKTSEYTFTDYAFHWVKQAPGKGLKWMGWINTYSGKPTYADDFKGRFVFSLEDSARTANLQISNLKNEDTATYFCARGAYYGYRDWFTYWGQGTLVTVSSGGGGSGGGGSGGGGSGGGGSDIVMTQTPSSQAVSAGEKVTMSCKSSQSLLYSENKKNYLAWYQQKPGQSPKLLIYWASTRESGVPDRFIGSGSGTDFTLTISSVQAEDLAVYYCQQYYNFPPWTFGGGTKLELKGSHHHHHHHH

SEQ ID NO: 804 - DNA, 1497 bp, Artificial Sequence
  Description of Artificial Sequence: Synthetic polynucleotide
atggccctccctgtcaccgccctgctgcttccgctggctcttctgctccacgccgctcggccccaaattcaactggtccagtccggccctgagctgaagaagccgggagaatccgtgaagatctcctgcaagacctcggagtacaccttcactgactacgccttccactgggtcaagcaggcacctgggaaaggcctgaagtggatgggctggatcaacacttactcggggaagccaacctacgccgatgatttcaagggaagattcgtgtttagcctggaggactccgcccggacagctaacctccaaatctccaaccttaagaacgaggacactgcgacctacttctgcgcgcggggagcctattacggttatcgcgactggttcacctactggggacagggcaccctcgtgaccgtgtcctccggcggtggaggctcaggggggggcggctcgggagggggtggaagcggaggaggaggctccgatattgtgatgacccagaccccgtcgagccaggcagtgtccgctggagaaaaggtcaccatgtcctgcaagagctcacagtccctgttgtactccgaaaacaagaagaattacctggcctggtaccagcagaagcccggacagtcccctaaactgctgatctactgggcctcgactagggaatctggcgtgcccgaccgctttatcggaagcggttcagggactgacttcaccctgaccattagcagcgtgcaggccgaggacctggcggtgtactactgtcaacagtactacaacttcccgccctggactttcggcggtggaacgaagctcgaactcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 805 - protein, 499 aa, Artificial Sequence
  Description of Artificial Sequence: Synthetic polypeptide
MALPVTALLLPLALLLHAARPQIQLVQSGPELKKPGESVKISCKTSEYTFTDYAFHWVKQAPGKGLKWMGWINTYSGKPTYADDFKGRFVFSLEDSARTANLQISNLKNEDTATYFCARGAYYGYRDWFTYWGQGTLVTVSSGGGGSGGGGSGGGGSGGGGSDIVMTQTPSSQAVSAGEKVTMSCKSSQSLLYSENKKNYLAWYQQKPGQSPKLLIYWASTRESGVPDRFIGSGSGTDFTLTISSVQAEDLAVYYCQQYYNFPPWTFGGGTKLELKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 806 - protein, 248 aa, Artificial Sequence
  Description of Artificial Sequence: Synthetic polypeptide
EVQLVESGGGLVQPGRSLKLSCLASGFTFSKYGMNWIRQAPGKGLEWVASISSTSIYIYYADTVKGRFTISRENAKNTLYLQMTSLRSEDTALYYCARHDYSSYSYWGQGVMVTVSSGGGGSGGGGSGGGGSGGGGSQVVLTQPKSVSTSLESTVKLSCKINSGNIGSYFIHWYQQHEGRSPTTMIYRDDKRPHGVPDRFSGSIDSSSNSAFLTINNVQTEDEAIYFCHSYDSGINIVFGGGTKLTVL

SEQ ID NO: 807 - DNA, 744 bp, Artificial Sequence
  Description of Artificial Sequence: Synthetic polynucleotide
gaggtgcagctcgtcgaatccggtggaggactggtgcagccaggaagatccctgaagctgtcctgtctcgcctcgggcttcactttctccaaatacggcatgaattggattcgccaggcacccggaaaggggctggaatgggtggccagcatcagctcgactagcatctacatctactatgccgataccgtcaagggccgcttcactatctcccgcgagaacgctaagaacaccctttacttgcaaatgacctccctgaggtccgaagataccgccctgtactattgcgcccggcacgactactcatcctactcctactggggacagggagtcatggtgaccgtgtcctccggcggtggaggctcaggggggggcggctcgggagggggtggaagcggaggaggaggctcccaagtcgtgctgacgcaacccaagtccgtgagcaccagcctggagagcaccgtgaagctcagctgcaagattaactcgggcaacattgggtcctacttcatccattggtaccagcagcacgaaggacggtcccctaccactatgatctaccgggacgacaagcggccgcacggagtgccggacagattctcgggttcaatcgattcctcatctaactcggcgtttctcaccatcaacaacgtgcagaccgaggacgaagcgatctacttctgccactcctacgactcgggtattaacattgtgttcggcggcgggactaagctgacagtgctg

SEQ ID NO: 808 - DNA, 837 bp, Artificial Sequence
  Description of Artificial Sequence: Synthetic polynucleotide
atggccctccctgtcaccgccctgctgcttccgctggctcttctgctccacgccgctcggcccgaggtgcagctcgtcgaatccggtggaggactggtgcagccaggaagatccctgaagctgtcctgtctcgcctcgggcttcactttctccaaatacggcatgaattggattcgccaggcacccggaaaggggctggaatgggtggccagcatcagctcgactagcatctacatctactatgccgataccgtcaagggccgcttcactatctcccgcgagaacgctaagaacaccctttacttgcaaatgacctccctgaggtccgaagataccgccctgtactattgcgcccggcacgactactcatcctactcctactggggacagggagtcatggtgaccgtgtcctccggcggtggaggctcaggggggggcggctcgggagggggtggaagcggaggaggaggctcccaagtcgtgctgacgcaacccaagtccgtgagcaccagcctggagagcaccgtgaagctcagctgcaagattaactcgggcaacattgggtcctacttcatccattggtaccagcagcacgaaggacggtcccctaccactatgatctaccgggacgacaagcggccgcacggagtgccggacagattctcgggttcaatcgattcctcatctaactcggcgtttctcaccatcaacaacgtgcagaccgaggacgaagcgatctacttctgccactcctacgactcgggtattaacattgtgttcggcggcgggactaagctgacagtgctgggatcgcaccaccatcaccatcatcatcac

SEQ ID NO: 809 - protein, 279 aa, Artificial Sequence
  Description of Artificial Sequence: Synthetic polypeptide
MALPVTALLLPLALLLHAARPEVQLVESGGGLVQPGRSLKLSCLASGFTFSKYGMNWIRQAPGKGLEWVASISSTSIYIYYADTVKGRFTISRENAKNTLYLQMTSLRSEDTALYYCARHDYSSYSYWGQGVMVTVSSGGGGSGGGGSGGGGSGGGGSQVVLTQPKSVSTSLESTVKLSCKINSGNIGSYFIHWYQQHEGRSPTTMIYRDDKRPHGVPDRFSGSIDSSSNSAFLTINNVQTEDEAIYFCHSYDSGINIVFGGGTKLTVLGSHHHHHHHH

SEQ ID NO: 810 - DNA, 1476 bp, Artificial Sequence
  Description of Artificial Sequence: Synthetic polynucleotide
atggccctccctgtcaccgccctgctgcttccgctggctcttctgctccacgccgctcggcccgaggtgcagctcgtcgaatccggtggaggactggtgcagccaggaagatccctgaagctgtcctgtctcgcctcgggcttcactttctccaaatacggcatgaattggattcgccaggcacccggaaaggggctggaatgggtggccagcatcagctcgactagcatctacatctactatgccgataccgtcaagggccgcttcactatctcccgcgagaacgctaagaacaccctttacttgcaaatgacctccctgaggtccgaagataccgccctgtactattgcgcccggcacgactactcatcctactcctactggggacagggagtcatggtgaccgtgtcctccggcggtggaggctcaggggggggcggctcgggagggggtggaagcggaggaggaggctcccaagtcgtgctgacgcaacccaagtccgtgagcaccagcctggagagcaccgtgaagctcagctgcaagattaactcgggcaacattgggtcctacttcatccattggtaccagcagcacgaaggacggtcccctaccactatgatctaccgggacgacaagcggccgcacggagtgccggacagattctcgggttcaatcgattcctcatctaactcggcgtttctcaccatcaacaacgtgcagaccgaggacgaagcgatctacttctgccactcctacgactcgggtattaacattgtgttcggcggcgggactaagctgacagtgctgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 811 - protein, 492 aa, Artificial Sequence
  Description of Artificial Sequence: Synthetic polypeptide
MALPVTALLLPLALLLHAARPEVQLVESGGGLVQPGRSLKLSCLASGFTFSKYGMNWIRQAPGKGLEWVASISSTSIYIYYADTVKGRFTISRENAKNTLYLQMTSLRSEDTALYYCARHDYSSYSYWGQGVMVTVSSGGGGSGGGGSGGGGSGGGGSQVVLTQPKSVSTSLESTVKLSCKINSGNIGSYFIHWYQQHEGRSPTTMIYRDDKRPHGVPDRFSGSIDSSSNSAFLTINNVQTEDEAIYFCHSYDSGINIVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 812 - protein, 251 aa, Artificial Sequence
  Description of Artificial Sequence: Synthetic polypeptide
EVQLVESGGGLVQPGRSLKLSCAASGFTFRDYYMAWVRQAPKKGLEWVASISYEGNPYYGDSVKGRFTISRNNAKSTLYLQMNSLRSEDTATYYCARHDHNNVDWFAYWGQGTLVTVSSGGGGSGGGGSGGGGSGGGGSDIVMTQTPSSQAVSAGEKVTMSCKSSQSLLYSENKKNYLAWYQQKPGQSPKLLIFWASTRESGVPDRFIGSGSGTDFTLTISSVQAEDLAVYYCQQYYNFPTFGSGTKLEIK

SEQ ID NO: 813 - DNA, 753 bp, Artificial Sequence
  Description of Artificial Sequence: Synthetic polynucleotide
gaagtgcagcttgtggagtctggcggcggtctggtgcagccgggaagatccctgaagctgtcatgcgccgcgtccgggtttaccttccgcgattactacatggcctgggtcagacaggcacctaagaaggggctggaatgggtggcatccatctcatatgaaggaaacccgtactacggagactcggtgaaaggccgcttcactatctcacggaacaacgctaagagcacgctgtacttgcaaatgaactccctccggtcggaggacacagccacttactactgtgcccggcacgaccataacaacgtcgattggttcgcctactggggtcaaggaaccctcgtgaccgtgtcctccggcggtggaggctcaggggggggcggctcgggagggggtggaagcggaggaggaggctccgacatcgtgatgactcagactccaagcagccaggccgtgtccgccggagagaaagtcaccatgtcgtgcaagagctcccagtccctgctgtactccgaaaacaagaagaattatctcgcctggtaccagcagaagcctggacagtccccgaagctcctgatcttttgggcgtcgaccagggaatccggcgtgcccgatcgcttcattggctccggttccggcaccgacttcaccctgaccattagcagcgtccaggcggaggacctggctgtgtactactgccaacagtactacaacttccccactttcggatcggggaccaagctggagatcaag

SEQ ID NO: 814 - DNA, 846 bp, Artificial Sequence
  Description of Artificial Sequence: Synthetic polynucleotide
atggccctccctgtcaccgccctgctgcttccgctggctcttctgctccacgccgctcggcccgaagtgcagcttgtggagtctggcggcggtctggtgcagccgggaagatccctgaagctgtcatgcgccgcgtccgggtttaccttccgcgattactacatggcctgggtcagacaggcacctaagaaggggctggaatgggtggcatccatctcatatgaaggaaacccgtactacggagactcggtgaaaggccgcttcactatctcacggaacaacgctaagagcacgctgtacttgcaaatgaactccctccggtcggaggacacagccacttactactgtgcccggcacgaccataacaacgtcgattggttcgcctactggggtcaaggaaccctcgtgaccgtgtcctccggcggtggaggctcaggggggggcggctcgggagggggtggaagcggaggaggaggctccgacatcgtgatgactcagactccaagcagccaggccgtgtccgccggagagaaagtcaccatgtcgtgcaagagctcccagtccctgctgtactccgaaaacaagaagaattatctcgcctggtaccagcagaagcctggacagtccccgaagctcctgatcttttgggcgtcgaccagggaatccggcgtgcccgatcgcttcattggctccggttccggcaccgacttcaccctgaccattagcagcgtccaggcggaggacctggctgtgtactactgccaacagtactacaacttccccactttcggatcggggaccaagctggagatcaagggatcgcaccaccatcaccatcatcatcac

SEQ ID NO: 815 - protein, 282 aa, Artificial Sequence
  Description of Artificial Sequence: Synthetic polypeptide
MALPVTALLLPLALLLHAARPEVQLVESGGGLVQPGRSLKLSCAASGFTFRDYYMAWVRQAPKKGLEWVASISYEGNPYYGDSVKGRFTISRNNAKSTLYLQMNSLRSEDTATYYCARHDHNNVDWFAYWGQGTLVTVSSGGGGSGGGGSGGGGSGGGGSDIVMTQTPSSQAVSAGEKVTMSCKSSQSLLYSENKKNYLAWYQQKPGQSPKLLIFWASTRESGVPDRFIGSGSGTDFTLTISSVQAEDLAVYYCQQYYNFPTFGSGTKLEIKGSHHHHHHHH

SEQ ID NO: 816 - DNA, 1485 bp, Artificial Sequence
  Description of Artificial Sequence: Synthetic polynucleotide
atggccctccctgtcaccgccctgctgcttccgctggctcttctgctccacgccgctcggcccgaagtgcagcttgtggagtctggcggcggtctggtgcagccgggaagatccctgaagctgtcatgcgccgcgtccgggtttaccttccgcgattactacatggcctgggtcagacaggcacctaagaaggggctggaatgggtggcatccatctcatatgaaggaaacccgtactacggagactcggtgaaaggccgcttcactatctcacggaacaacgctaagagcacgctgtacttgcaaatgaactccctccggtcggaggacacagccacttactactgtgcccggcacgaccataacaacgtcgattggttcgcctactggggtcaaggaaccctcgtgaccgtgtcctccggcggtggaggctcaggggggggcggctcgggagggggtggaagcggaggaggaggctccgacatcgtgatgactcagactccaagcagccaggccgtgtccgccggagagaaagtcaccatgtcgtgcaagagctcccagtccctgctgtactccgaaaacaagaagaattatctcgcctggtaccagcagaagcctggacagtccccgaagctcctgatcttttgggcgtcgaccagggaatccggcgtgcccgatcgcttcattggctccggttccggcaccgacttcaccctgaccattagcagcgtccaggcggaggacctggctgtgtactactgccaacagtactacaacttccccactttcggatcggggaccaagctggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 817 - protein, 495 aa, Artificial Sequence
  Description of Artificial Sequence: Synthetic polypeptide
MALPVTALLLPLALLLHAARPEVQLVESGGGLVQPGRSLKLSCAASGFTFRDYYMAWVRQAPKKGLEWVASISYEGNPYYGDSVKGRFTISRNNAKSTLYLQMNSLRSEDTATYYCARHDHNNVDWFAYWGQGTLVTVSSGGGGSGGGGSGGGGSGGGGSDIVMTQTPSSQAVSAGEKVTMSCKSSQSLLYSENKKNYLAWYQQKPGQSPKLLIFWASTRESGVPDRFIGSGSGTDFTLTISSVQAEDLAVYYCQQYYNFPTFGSGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 818 - protein, 251 aa, Artificial Sequence
  Description of Artificial Sequence: Synthetic polypeptide
QVTLKESGPGILQPSQTLSLTCTFTRFSLSTYGMSVGWIRQPSGKGLEWLADIWWDDDKHYNPSLKNRLTISKDTSKNQAFLKITNVDTADTATYYCARSSTTDGIVTYVMDVWGQGASVTVSSGGGGSGGGGSGGGGSGGGGSDVQMTQSPSLLSASVGDAVTINCKASQNINRYLNWYQQKLGEGPRLLIYSANSLQTGIPSRFSGSGSGADFTLTITSPQPEDVATYFCLQHNSWPLTFGSGTKLEIK

SEQ ID NO: 819 - DNA, 753 bp, Artificial Sequence
  Description of Artificial Sequence: Synthetic polynucleotide
caagtcacgctgaaggaatcgggccctggaattctgcagccaagccagaccctctcgcttacttgcaccttcacccgcttctcactgtccacttacggaatgtccgtgggatggattcggcagcccagcggaaagggtttggagtggctggccgacatttggtgggatgacgacaagcattacaaccctagcctgaagaatcggctcaccatcagcaaagacacctccaagaaccaggcgttcctgaagatcaccaacgtggataccgccgacactgcaacatactattgtgcccgctcctcaaccaccgatgggatcgtgacctacgtgatggacgtctggggccagggagcttccgtgaccgtgtcctccggcggtggaggctcaggggggggcggctcgggagggggtggaagcggaggaggaggctccgacgtgcagatgactcagtccccgtcgctcctgtccgcctccgtcggcgacgccgtgactattaactgcaaggcgtcccagaacatcaatcggtacctgaactggtaccagcaaaaactgggagaagggccgagacttctcatctactccgccaactccctgcaaactggcatcccgtcgaggttcagcggatcaggctctggtgccgacttcactttgaccatcacgagccctcagcccgaagatgtggccacctacttctgcctccaacacaactcctggcccctgacctttggttcgggcaccaagctggagatcaag

SEQ ID NO: 820 - DNA, 846 bp, Artificial Sequence
  Description of Artificial Sequence: Synthetic polynucleotide
atggccctccctgtcaccgccctgctgcttccgctggctcttctgctccacgccgctcggccccaagtcacgctgaaggaatcgggccctggaattctgcagccaagccagaccctctcgcttacttgcaccttcacccgcttctcactgtccacttacggaatgtccgtgggatggattcggcagcccagcggaaagggtttggagtggctggccgacatttggtgggatgacgacaagcattacaaccctagcctgaagaatcggctcaccatcagcaaagacacctccaagaaccaggcgttcctgaagatcaccaacgtggataccgccgacactgcaacatactattgtgcccgctcctcaaccaccgatgggatcgtgacctacgtgatggacgtctggggccagggagcttccgtgaccgtgtcctccggcggtggaggctcaggggggggcggctcgggagggggtggaagcggaggaggaggctccgacgtgcagatgactcagtccccgtcgctcctgtccgcctccgtcggcgacgccgtgactattaactgcaaggcgtcccagaacatcaatcggtacctgaactggtaccagcaaaaactgggagaagggccgagacttctcatctactccgccaactccctgcaaactggcatcccgtcgaggttcagcggatcaggctctggtgccgacttcactttgaccatcacgagccctcagcccgaagatgtggccacctacttctgcctccaacacaactcctggcccctgacctttggttcgggcaccaagctggagatcaagggatcgcaccaccatcaccatcatcatcac

SEQ ID NO: 821 - protein, 282 aa, Artificial Sequence
  Description of Artificial Sequence: Synthetic polypeptide
MALPVTALLLPLALLLHAARPQVTLKESGPGILQPSQTLSLTCTFTRFSLSTYGMSVGWIRQPSGKGLEWLADIWWDDDKHYNPSLKNRLTISKDTSKNQAFLKITNVDTADTATYYCARSSTTDGIVTYVMDVWGQGASVTVSSGGGGSGGGGSGGGGSGGGGSDVQMTQSPSLLSASVGDAVTINCKASQNINRYLNWYQQKLGEGPRLLIYSANSLQTGIPSRFSGSGSGADFTLTITSPQPEDVATYFCLQHNSWPLTFGSGTKLEIKGSHHHHHHHH

SEQ ID NO: 822 - DNA, 1485 bp, Artificial Sequence
  Description of Artificial Sequence: Synthetic polynucleotide
atggccctccctgtcaccgccctgctgcttccgctggctcttctgctccacgccgctcggccccaagtcacgctgaaggaatcgggccctggaattctgcagccaagccagaccctctcgcttacttgcaccttcacccgcttctcactgtccacttacggaatgtccgtgggatggattcggcagcccagcggaaagggtttggagtggctggccgacatttggtgggatgacgacaagcattacaaccctagcctgaagaatcggctcaccatcagcaaagacacctccaagaaccaggcgttcctgaagatcaccaacgtggataccgccgacactgcaacatactattgtgcccgctcctcaaccaccgatgggatcgtgacctacgtgatggacgtctggggccagggagcttccgtgaccgtgtcctccggcggtggaggctcaggggggggcggctcgggagggggtggaagcggaggaggaggctccgacgtgcagatgactcagtccccgtcgctcctgtccgcctccgtcggcgacgccgtgactattaactgcaaggcgtcccagaacatcaatcggtacctgaactggtaccagcaaaaactgggagaagggccgagacttctcatctactccgccaactccctgcaaactggcatcccgtcgaggttcagcggatcaggctctggtgccgacttcactttgaccatcacgagccctcagcccgaagatgtggccacctacttctgcctccaacacaactcctggcccctgacctttggttcgggcaccaagctggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 823 - protein, 495 aa, Artificial Sequence
  Description of Artificial Sequence: Synthetic polypeptide
MALPVTALLLPLALLLHAARPQVTLKESGPGILQPSQTLSLTCTFTRFSLSTYGMSVGWIRQPSGKGLEWLADIWWDDDKHYNPSLKNRLTISKDTSKNQAFLKITNVDTADTATYYCARSSTTDGIVTYVMDVWGQGASVTVSSGGGGSGGGGSGGGGSGGGGSDVQMTQSPSLLSASVGDAVTINCKASQNINRYLNWYQQKLGEGPRLLIYSANSLQTGIPSRFSGSGSGADFTLTITSPQPEDVATYFCLQHNSWPLTFGSGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 824 - protein, 248 aa, Artificial Sequence
  Description of Artificial Sequence: Synthetic polypeptide
EVQLVESGGGLVQPGTSLKLSCVASGFTFSSSGMQWIRQAPKKGLEWISGIYYDSYKKSYADSVKGRFTISRDNSKNTLYLEMNSLRSEDTATYYCAKSAYYGYKDYFDYWGQGVMVTVSSGGGGSGGGGSGGGGSGGGGSDIQMTQSPPSLSASLGDKVTITCQASQNINKYIAWYQQKPGKAPRLLIRYTSTLESGTPSRFSGSGSGRDYSFSISNVESGDVASYYCLQYDDLPYTFGPGTKLELK

SEQ ID NO: 825 - DNA, 744 bp, Artificial Sequence
  Description of Artificial Sequence: Synthetic polynucleotide
gaggtccagcttgtggaatcaggaggcggactcgtccagccgggtactagcctgaagctcagctgtgtggccagcggttttaccttctcgtcctccgggatgcagtggattcggcaggctcccaagaagggactggaatggatctcgggcatctactacgactcgtacaagaagtcctacgccgattccgtgaaaggtcgcttcaccatctcccgggacaacagcaagaacactctgtacctcgagatgaactccttgcgctccgaggataccgcaacctattactgcgccaagtcggcctactacggctacaaggactacttcgactattggggccagggagtgatggtgaccgtgtcctccggcggtggaggctcaggggggggcggctcgggagggggtggaagcggaggaggaggctccgacatccaaatgacacagtcacccccttctctttccgcgagcctgggagataaggtcaccattacgtgccaagcgtcccagaacatcaacaagtacatcgcctggtaccagcagaaaccgggaaaggccccgcggctgctgattagatacacctcgactctggaatccggcactccatcaagattcagcggctccggcagcgggagggactactcgttctccatctccaatgtggagtccggggacgtggccagctactattgcctgcaatacgacgatctgccctacaccttcggacctggaaccaagctggaactcaag

SEQ ID NO: 826 - DNA, 837 bp, Artificial Sequence
  Description of Artificial Sequence: Synthetic polynucleotide
atggccctccctgtcaccgccctgctgcttccgctggctcttctgctccacgccgctcggcccgaggtccagcttgtggaatcaggaggcggactcgtccagccgggtactagcctgaagctcagctgtgtggccagcggttttaccttctcgtcctccgggatgcagtggattcggcaggctcccaagaagggactggaatggatctcgggcatctactacgactcgtacaagaagtcctacgccgattccgtgaaaggtcgcttcaccatctcccgggacaacagcaagaacactctgtacctcgagatgaactccttgcgctccgaggataccgcaacctattactgcgccaagtcggcctactacggctacaaggactacttcgactattggggccagggagtgatggtgaccgtgtcctccggcggtggaggctcaggggggggcggctcgggagggggtggaagcggaggaggaggctccgacatccaaatgacacagtcacccccttctctttccgcgagcctgggagataaggtcaccattacgtgccaagcgtcccagaacatcaacaagtacatcgcctggtaccagcagaaaccgggaaaggccccgcggctgctgattagatacacctcgactctggaatccggcactccatcaagattcagcggctccggcagcgggagggactactcgttctccatctccaatgtggagtccggggacgtggccagctactattgcctgcaatacgacgatctgccctacaccttcggacctggaaccaagctggaactcaagggatcgcaccaccatcaccatcatcatcac

SEQ ID NO: 827 - protein, 279 aa, Artificial Sequence
  Description of Artificial Sequence: Synthetic polypeptide
MALPVTALLLPLALLLHAARPEVQLVESGGGLVQPGTSLKLSCVASGFTFSSSGMQWIRQAPKKGLEWISGIYYDSYKKSYADSVKGRFTISRDNSKNTLYLEMNSLRSEDTATYYCAKSAYYGYKDYFDYWGQGVMVTVSSGGGGSGGGGSGGGGSGGGGSDIQMTQSPPSLSASLGDKVTITCQASQNINKYIAWYQQKPGKAPRLLIRYTSTLESGTPSRFSGSGSGRDYSFSISNVESGDVASYYCLQYDDLPYTFGPGTKLELKGSHHHHHHHH

SEQ ID NO: 828 - DNA, 1476 bp, Artificial Sequence
  Description of Artificial Sequence: Synthetic polynucleotide
atggccctccctgtcaccgccctgctgcttccgctggctcttctgctccacgccgctcggcccgaggtccagcttgtggaatcaggaggcggactcgtccagccgggtactagcctgaagctcagctgtgtggccagcggttttaccttctcgtcctccgggatgcagtggattcggcaggctcccaagaagggactggaatggatctcgggcatctactacgactcgtacaagaagtcctacgccgattccgtgaaaggtcgcttcaccatctcccgggacaacagcaagaacactctgtacctcgagatgaactccttgcgctccgaggataccgcaacctattactgcgccaagtcggcctactacggctacaaggactacttcgactattggggccagggagtgatggtgaccgtgtcctccggcggtggaggctcaggggggggcggctcgggagggggtggaagcggaggaggaggctccgacatccaaatgacacagtcacccccttctctttccgcgagcctgggagataaggtcaccattacgtgccaagcgtcccagaacatcaacaagtacatcgcctggtaccagcagaaaccgggaaaggccccgcggctgctgattagatacacctcgactctggaatccggcactccatcaagattcagcggctccggcagcgggagggactactcgttctccatctccaatgtggagtccggggacgtggccagctactattgcctgcaatacgacgatctgccctacaccttcggacctggaaccaagctggaactcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 829 - protein, 492 aa, Artificial Sequence
  Description of Artificial Sequence: Synthetic polypeptide
MALPVTALLLPLALLLHAARPEVQLVESGGGLVQPGTSLKLSCVASGFTFSSSGMQWIRQAPKKGLEWISGIYYDSYKKSYADSVKGRFTISRDNSKNTLYLEMNSLRSEDTATYYCAKSAYYGYKDYFDYWGQGVMVTVSSGGGGSGGGGSGGGGSGGGGSDIQMTQSPPSLSASLGDKVTITCQASQNINKYIAWYQQKPGKAPRLLIRYTSTLESGTPSRFSGSGSGRDYSFSISNVESGDVASYYCLQYDDLPYTFGPGTKLELKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 830 - protein, 250 aa, Artificial Sequence
  Description of Artificial Sequence: Synthetic polypeptide
QVTLKESGPGLLQPSQTLSLTCTFAGFSLNTHGMGVGWIRQPSGKGLEWLANIWWDDDKYYNPSLKNRLTMSKDTSNNQAFLKITNVDTADTATYYCARIEGSPVVTTVFDYWGQGVMVTVSSGGGGSGGGGSGGGGSGGGGSDIQMTQSPSFLSASVGDRVTINCKASQNINRYLNWYQQKLGEAPKLLIYNANSLQTGIPSRFSGSGSGTDFTLTISSLQPADVATYFCLQHNSRPLTFGSGTILEIK

SEQ ID NO: 831 - DNA, 750 bp, Artificial Sequence
  Description of Artificial Sequence: Synthetic polynucleotide
caagtcactcttaaggaatccgggccaggactgttgcagccgagccagaccctgtccctcacttgtaccttcgccggcttttcactgaacacccacggaatgggcgtgggatggattaggcagccctcgggaaagggactggagtggctggccaacatttggtgggacgacgacaagtattacaacccgagcctcaagaaccgcctgactatgtccaaggatacctccaacaaccaggccttcctgaaaatcactaacgtggataccgctgacaccgcaacgtactactgcgcccggatcgaaggttcccccgtcgtgacaactgtgttcgactactggggacagggcgtgatggtgaccgtgtcctccggcggtggaggctcaggggggggcggctcgggagggggtggaagcggaggaggaggctccgacatccaaatgacccagtcacctagctttctgtcggcctcggtcggcgacagagtgaccattaactgcaaagcgtcccagaacatcaaccgctacctgaattggtaccagcagaagctgggggaagccccgaagctgctgatctacaacgcgaacagcctccagactggtattccttcccggttctccgggagcggctcgggtaccgatttcaccctcaccatctcctcccttcaacccgctgacgtggccacctacttctgcttgcaacataattctcggcctctgaccttcggaagcggcactatcctcgagatcaag

SEQ ID NO: 832 - DNA, 843 bp, Artificial Sequence
  Description of Artificial Sequence: Synthetic polynucleotide
atggccctccctgtcaccgccctgctgcttccgctggctcttctgctccacgccgctcggccccaagtcactcttaaggaatccgggccaggactgttgcagccgagccagaccctgtccctcacttgtaccttcgccggcttttcactgaacacccacggaatgggcgtgggatggattaggcagccctcgggaaagggactggagtggctggccaacatttggtgggacgacgacaagtattacaacccgagcctcaagaaccgcctgactatgtccaaggatacctccaacaaccaggccttcctgaaaatcactaacgtggataccgctgacaccgcaacgtactactgcgcccggatcgaaggttcccccgtcgtgacaactgtgttcgactactggggacagggcgtgatggtgaccgtgtcctccggcggtggaggctcaggggggggcggctcgggagggggtggaagcggaggaggaggctccgacatccaaatgacccagtcacctagctttctgtcggcctcggtcggcgacagagtgaccattaactgcaaagcgtcccagaacatcaaccgctacctgaattggtaccagcagaagctgggggaagccccgaagctgctgatctacaacgcgaacagcctccagactggtattccttcccggttctccgggagcggctcgggtaccgatttcaccctcaccatctcctcccttcaacccgctgacgtggccacctacttctgcttgcaacataattctcggcctctgaccttcggaagcggcactatcctcgagatcaagggatcgcaccaccatcaccatcatcatcac

SEQ ID NO: 833 - protein, 281 aa, Artificial Sequence
  Description of Artificial Sequence: Synthetic polypeptide
MALPVTALLLPLALLLHAARPQVTLKESGPGLLQPSQTLSLTCTFAGFSLNTHGMGVGWIRQPSGKGLEWLANIWWDDDKYYNPSLKNRLTMSKDTSNNQAFLKITNVDTADTATYYCARIEGSPVVTTVFDYWGQGVMVTVSSGGGGSGGGGSGGGGSGGGGSDIQMTQSPSFLSASVGDRVTINCKASQNINRYLNWYQQKLGEAPKLLIYNANSLQTGIPSRFSGSGSGTDFTLTISSLQPADVATYFCLQHNSRPLTFGSGTILEIKGSHHHHHHHH

SEQ ID NO: 834 - DNA, 1482 bp, Artificial Sequence
  Description of Artificial Sequence: Synthetic polynucleotide
atggccctccctgtcaccgccctgctgcttccgctggctcttctgctccacgccgctcggccccaagtcactcttaaggaatccgggccaggactgttgcagccgagccagaccctgtccctcacttgtaccttcgccggcttttcactgaacacccacggaatgggcgtgggatggattaggcagccctcgggaaagggactggagtggctggccaacatttggtgggacgacgacaagtattacaacccgagcctcaagaaccgcctgactatgtccaaggatacctccaacaaccaggccttcctgaaaatcactaacgtggataccgctgacaccgcaacgtactactgcgcccggatcgaaggttcccccgtcgtgacaactgtgttcgactactggggacagggcgtgatggtgaccgtgtcctccggcggtggaggctcaggggggggcggctcgggagggggtggaagcggaggaggaggctccgacatccaaatgacccagtcacctagctttctgtcggcctcggtcggcgacagagtgaccattaactgcaaagcgtcccagaacatcaaccgctacctgaattggtaccagcagaagctgggggaagccccgaagctgctgatctacaacgcgaacagcctccagactggtattccttcccggttctccgggagcggctcgggtaccgatttcaccctcaccatctcctcccttcaacccgctgacgtggccacctacttctgcttgcaacataattctcggcctctgaccttcggaagcggcactatcctcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 835 - protein, 494 aa, Artificial Sequence
  Description of Artificial Sequence: Synthetic polypeptide
MALPVTALLLPLALLLHAARPQVTLKESGPGLLQPSQTLSLTCTFAGFSLNTHGMGVGWIRQPSGKGLEWLANIWWDDDKYYNPSLKNRLTMSKDTSNNQAFLKITNVDTADTATYYCARIEGSPVVTTVFDYWGQGVMVTVSSGGGGSGGGGSGGGGSGGGGSDIQMTQSPSFLSASVGDRVTINCKASQNINRYLNWYQQKLGEAPKLLIYNANSLQTGIPSRFSGSGSGTDFTLTISSLQPADVATYFCLQHNSRPLTFGSGTILEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 836 - protein, 248 aa, Artificial Sequence
  Description of Artificial Sequence: Synthetic polypeptide
QVTLKESGPGMLQPSKTLSLTCSFSGFSLSTSGMVVSWIRQPSGKSLEWLAAIAWDGDKYYNPSLKSRVTVSKDTSNTQVFLRITSVDIADTATYYCTRRDYDVGYYYFDFWGQGVMVTVSSGGGGSGGGGSGGGGSGGGGSKIVLTQSPTITAASPGEKVTITCLASSRVSNIYWYQQKSGASPKLLIYSTSSLASGVPYRFSGSGSGTSYSLTINTMEAEDAATYYCHQWSSNPWTFGGGTKLELK

SEQ ID NO: 837 - DNA, 744 bp, Artificial Sequence
  Description of Artificial Sequence: Synthetic polynucleotide
caagtcaccctgaaagaatcgggtcccggaatgctgcagccatccaagacgctgtcccttacatgctccttctccgggttcagcctctcaacttccgggatggtggtgtcatggatcagacagccgagcggaaagtccctggagtggctggcggccatcgcatgggatggcgataagtactacaacccgagcctgaagtcaagggtcactgtgtccaaggacacctccaacacccaagtgttccttcggatcacctccgtggacattgctgacaccgccacctattactgcactcgccgggactacgacgtgggctactactacttcgatttctggggacagggtgtcatggtgaccgtgtcctccggcggtggaggctcaggggggggcggctcgggagggggtggaagcggaggaggaggctccaagattgtgctgacccagagccccactattaccgccgcctccccgggggaaaaggtcaccatcacttgtctggcgtcctcacgcgtgtcgaatatctactggtatcagcagaagtccggcgccagccccaagctgctgatctactcgacctcctccctcgcgtcgggagtgccttaccggttttctggctcgggaagcggaaccagctactccttgaccatcaacaccatggaagccgaggacgctgccacttactactgccaccagtggtcgagcaacccttggactttcggtggaggcaccaaactcgagctcaag

SEQ ID NO: 838 - DNA, 837 bp, Artificial Sequence
  Description of Artificial Sequence: Synthetic polynucleotide
atggccctccctgtcaccgccctgctgcttccgctggctcttctgctccacgccgctcggccccaagtcaccctgaaagaatcgggtcccggaatgctgcagccatccaagacgctgtcccttacatgctccttctccgggttcagcctctcaacttccgggatggtggtgtcatggatcagacagccgagcggaaagtccctggagtggctggcggccatcgcatgggatggcgataagtactacaacccgagcctgaagtcaagggtcactgtgtccaaggacacctccaacacccaagtgttccttcggatcacctccgtggacattgctgacaccgccacctattactgcactcgccgggactacgacgtgggctactactacttcgatttctggggacagggtgtcatggtgaccgtgtcctccggcggtggaggctcaggggggggcggctcgggagggggtggaagcggaggaggaggctccaagattgtgctgacccagagccccactattaccgccgcctccccgggggaaaaggtcaccatcacttgtctggcgtcctcacgcgtgtcgaatatctactggtatcagcagaagtccggcgccagccccaagctgctgatctactcgacctcctccctcgcgtcgggagtgccttaccggttttctggctcgggaagcggaaccagctactccttgaccatcaacaccatggaagccgaggacgctgccacttactactgccaccagtggtcgagcaacccttggactttcggtggaggcaccaaactcgagctcaagggatcgcaccaccatcaccatcatcatcac

SEQ ID NO: 839 - protein, 279 aa, Artificial Sequence
  Description of Artificial Sequence: Synthetic polypeptide
MALPVTALLLPLALLLHAARPQVTLKESGPGMLQPSKTLSLTCSFSGFSLSTSGMVVSWIRQPSGKSLEWLAAIAWDGDKYYNPSLKSRVTVSKDTSNTQVFLRITSVDIADTATYYCTRRDYDVGYYYFDFWGQGVMVTVSSGGGGSGGGGSGGGGSGGGGSKIVLTQSPTITAASPGEKVTITCLASSRVSNIYWYQQKSGASPKLLIYSTSSLASGVPYRFSGSGSGTSYSLTINTMEAEDAATYYCHQWSSNPWTFGGGTKLELKGSHHHHHHHH

SEQ ID NO: 840 - DNA, 1476 bp, Artificial Sequence
  Description of Artificial Sequence: Synthetic polynucleotide
atggccctccctgtcaccgccctgctgcttccgctggctcttctgctccacgccgctcggccccaagtcaccctgaaagaatcgggtcccggaatgctgcagccatccaagacgctgtcccttacatgctccttctccgggttcagcctctcaacttccgggatggtggtgtcatggatcagacagccgagcggaaagtccctggagtggctggcggccatcgcatgggatggcgataagtactacaacccgagcctgaagtcaagggtcactgtgtccaaggacacctccaacacccaagtgttccttcggatcacctccgtggacattgctgacaccgccacctattactgcactcgccgggactacgacgtgggctactactacttcgatttctggggacagggtgtcatggtgaccgtgtcctccggcggtggaggctcaggggggggcggctcgggagggggtggaagcggaggaggaggctccaagattgtgctgacccagagccccactattaccgccgcctccccgggggaaaaggtcaccatcacttgtctggcgtcctcacgcgtgtcgaatatctactggtatcagcagaagtccggcgccagccccaagctgctgatctactcgacctcctccctcgcgtcgggagtgccttaccggttttctggctcgggaagcggaaccagctactccttgaccatcaacaccatggaagccgaggacgctgccacttactactgccaccagtggtcgagcaacccttggactttcggtggaggcaccaaactcgagctcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 841 - protein, 492 aa, Artificial Sequence
  Description of Artificial Sequence: Synthetic polypeptide
MALPVTALLLPLALLLHAARPQVTLKESGPGMLQPSKTLSLTCSFSGFSLSTSGMVVSWIRQPSGKSLEWLAAIAWDGDKYYNPSLKSRVTVSKDTSNTQVFLRITSVDIADTATYYCTRRDYDVGYYYFDFWGQGVMVTVSSGGGGSGGGGSGGGGSGGGGSKIVLTQSPTITAASPGEKVTITCLASSRVSNIYWYQQKSGASPKLLIYSTSSLASGVPYRFSGSGSGTSYSLTINTMEAEDAATYYCHQWSSNPWTFGGGTKLELKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 842 - protein, 247 aa, Artificial Sequence
  Description of Artificial Sequence: Synthetic polypeptide
QIQLVQSGPELKKPGESVKISCKASGNTVTGYAMHWVRQAPGKGLKWMGWINTYSGKPTYADDFKGRCVFSLEASASTAHLQISNLKNEDTATYFCARSTYYGYKDWFAYWGQGTLVTVSSGGGGSGGGGSGGGGSGGGGSNIQLTQSPSRLSASVGDRVTLSCKGSQNINNYLAWYQQKLGEAPKLLIYNTNNLQTGIPSRFSGSGSGTDYTFTISGLQPEDVATYFCCQYNNGNTFGAGTKLELK

SEQ ID NO: 843 - DNA, 741 bp, Artificial Sequence
  Description of Artificial Sequence: Synthetic polynucleotide
caaattcagttggtgcagtccggcccggagctgaagaagcctggagaatccgtgaagatctcgtgcaaagcttccgggaacaccgtgaccggatacgcaatgcactgggtccgccaggcaccgggaaagggactgaagtggatggggtggatcaacacctacagcggaaagccgacttacgccgatgactttaagggacgctgtgtgttctccctggaagcgtccgcctcgactgcccatcttcaaatctccaacctgaagaatgaggacaccgccacttacttctgcgcccggagcacctattacggctacaaggactggttcgcgtattggggccagggcactctcgtgaccgtgtcctccggcggtggaggctcaggggggggcggctcgggagggggtggaagcggaggaggaggctccaacatccaactgactcagagccccagccggctgtccgcctccgtgggggacagggtcacactgagctgcaagggttctcagaacatcaacaactacctcgcgtggtaccagcagaagctgggagaggcccccaagctgctcatctacaacaccaacaatctgcaaactggcattccatcgagattctcaggatcagggtccggtaccgactacaccttcacgatttcgggacttcagcctgaggatgtggccacctacttctgctgtcagtacaacaacggcaacaccttcggtgctggcaccaagctggaactcaaa

SEQ ID NO: 844 - DNA, 834 bp, Artificial Sequence
  Description of Artificial Sequence: Synthetic polynucleotide
atggccctccctgtcaccgccctgctgcttccgctggctcttctgctccacgccgctcggccccaaattcagttggtgcagtccggcccggagctgaagaagcctggagaatccgtgaagatctcgtgcaaagcttccgggaacaccgtgaccggatacgcaatgcactgggtccgccaggcaccgggaaagggactgaagtggatggggtggatcaacacctacagcggaaagccgacttacgccgatgactttaagggacgctgtgtgttctccctggaagcgtccgcctcgactgcccatcttcaaatctccaacctgaagaatgaggacaccgccacttacttctgcgcccggagcacctattacggctacaaggactggttcgcgtattggggccagggcactctcgtgaccgtgtcctccggcggtggaggctcaggggggggcggctcgggagggggtggaagcggaggaggaggctccaacatccaactgactcagagccccagccggctgtccgcctccgtgggggacagggtcacactgagctgcaagggttctcagaacatcaacaactacctcgcgtggtaccagcagaagctgggagaggcccccaagctgctcatctacaacaccaacaatctgcaaactggcattccatcgagattctcaggatcagggtccggtaccgactacaccttcacgatttcgggacttcagcctgaggatgtggccacctacttctgctgtcagtacaacaacggcaacaccttcggtgctggcaccaagctggaactcaaaggatcgcaccaccatcaccatcatcatcac

SEQ ID NO: 845 - protein, 278 aa, Artificial Sequence
  Description of Artificial Sequence: Synthetic polypeptide
MALPVTALLLPLALLLHAARPQIQLVQSGPELKKPGESVKISCKASGNTVTGYAMHWVRQAPGKGLKWMGWINTYSGKPTYADDFKGRCVFSLEASASTAHLQISNLKNEDTATYFCARSTYYGYKDWFAYWGQGTLVTVSSGGGGSGGGGSGGGGSGGGGSNIQLTQSPSRLSASVGDRVTLSCKGSQNINNYLAWYQQKLGEAPKLLIYNTNNLQTGIPSRFSGSGSGTDYTFTISGLQPEDVATYFCCQYNNGNTFGAGTKLELKGSHHHHHHHH

SEQ ID NO: 846 - DNA, 1473 bp, Artificial Sequence
  Description of Artificial Sequence: Synthetic polynucleotide
atggccctccctgtcaccgccctgctgcttccgctggctcttctgctccacgccgctcggccccaaattcagttggtgcagtccggcccggagctgaagaagcctggagaatccgtgaagatctcgtgcaaagcttccgggaacaccgtgaccggatacgcaatgcactgggtccgccaggcaccgggaaagggactgaagtggatggggtggatcaacacctacagcggaaagccgacttacgccgatgactttaagggacgctgtgtgttctccctggaagcgtccgcctcgactgcccatcttcaaatctccaacctgaagaatgaggacaccgccacttacttctgcgcccggagcacctattacggctacaaggactggttcgcgtattggggccagggcactctcgtgaccgtgtcctccggcggtggaggctcaggggggggcggctcgggagggggtggaagcggaggaggaggctccaacatccaactgactcagagccccagccggctgtccgcctccgtgggggacagggtcacactgagctgcaagggttctcagaacatcaacaactacctcgcgtggtaccagcagaagctgggagaggcccccaagctgctcatctacaacaccaacaatctgcaaactggcattccatcgagattctcaggatcagggtccggtaccgactacaccttcacgatttcgggacttcagcctgaggatgtggccacctacttctgctgtcagtacaacaacggcaacaccttcggtgctggcaccaagctggaactcaaaaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 847 - protein, 491 aa, Artificial Sequence
  Description of Artificial Sequence: Synthetic polypeptide
MALPVTALLLPLALLLHAARPQIQLVQSGPELKKPGESVKISCKASGNTVTGYAMHWVRQAPGKGLKWMGWINTYSGKPTYADDFKGRCVFSLEASASTAHLQISNLKNEDTATYFCARSTYYGYKDWFAYWGQGTLVTVSSGGGGSGGGGSGGGGSGGGGSNIQLTQSPSRLSASVGDRVTLSCKGSQNINNYLAWYQQKLGEAPKLLIYNTNNLQTGIPSRFSGSGSGTDYTFTISGLQPEDVATYFCCQYNNGNTFGAGTKLELKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 848 - protein, 251 aa, Artificial Sequence
  Description of Artificial Sequence: Synthetic polypeptide
DIVMTQTPSSQAVSAGEKVTMSCKSSQSLLYSENKKNYLAWYQQKPGQSPKLLIFWASTRESGVPDRFIGSGSGTDFTLTISSVQAEDLAVYYCQQYYNFPTFGSGTKLEIKGGGGSGGGGSGGGGSGGGGSEVQLVESGGGLVQPGRSLKLSCAASGFTFRDYYMAWVRQAPKKGLEWVASISYEGNPYYGDSVKGRFTISRNNAKSTLYLQMNSLRSEDTATYYCARHDHNNVDWFAYWGQGTLVTVSS

SEQ ID NO: 849 - DNA, 753 bp, Artificial Sequence
  Description of Artificial Sequence: Synthetic polynucleotide
gacatcgtgatgactcagactccaagcagccaggccgtgtccgccggagagaaagtcaccatgtcgtgcaagagctcccagtccctgctgtactccgaaaacaagaagaattatctcgcctggtaccagcagaagcctggacagtccccgaagctcctgatcttttgggcgtcgaccagggaatccggcgtgcccgatcgcttcattggctccggttccggcaccgacttcaccctgaccattagcagcgtccaggcggaggacctggctgtgtactactgccaacagtactacaacttccccactttcggatcggggaccaagctggagatcaagggcggtggaggctcaggggggggcggctcgggagggggtggaagcggaggaggaggctccgaagtgcagcttgtggagtctggcggcggtctggtgcagccgggaagatccctgaagctgtcatgcgccgcgtccgggtttaccttccgcgattactacatggcctgggtcagacaggcacctaagaaggggctggaatgggtggcatccatctcatatgaaggaaacccgtactacggagactcggtgaaaggccgcttcactatctcacggaacaacgctaagagcacgctgtacttgcaaatgaactccctccggtcggaggacacagccacttactactgtgcccggcacgaccataacaacgtcgattggttcgcctactggggtcaaggaaccctcgtgaccgtgtcctcc

SEQ ID NO: 850 - DNA, 846 bp, Artificial Sequence
  Description of Artificial Sequence: Synthetic polynucleotide
atggccctccctgtcaccgccctgctgcttccgctggctcttctgctccacgccgctcggcccgacatcgtgatgactcagactccaagcagccaggccgtgtccgccggagagaaagtcaccatgtcgtgcaagagctcccagtccctgctgtactccgaaaacaagaagaattatctcgcctggtaccagcagaagcctggacagtccccgaagctcctgatcttttgggcgtcgaccagggaatccggcgtgcccgatcgcttcattggctccggttccggcaccgacttcaccctgaccattagcagcgtccaggcggaggacctggctgtgtactactgccaacagtactacaacttccccactttcggatcggggaccaagctggagatcaagggcggtggaggctcaggggggggcggctcgggagggggtggaagcggaggaggaggctccgaagtgcagcttgtggagtctggcggcggtctggtgcagccgggaagatccctgaagctgtcatgcgccgcgtccgggtttaccttccgcgattactacatggcctgggtcagacaggcacctaagaaggggctggaatgggtggcatccatctcatatgaaggaaacccgtactacggagactcggtgaaaggccgcttcactatctcacggaacaacgctaagagcacgctgtacttgcaaatgaactccctccggtcggaggacacagccacttactactgtgcccggcacgaccataacaacgtcgattggttcgcctactggggtcaaggaaccctcgtgaccgtgtcctccggatcgcaccaccatcaccatcatcatcac

SEQ ID NO: 851 - protein, 282 aa, Artificial Sequence
  Description of Artificial Sequence: Synthetic polypeptide
MALPVTALLLPLALLLHAARPDIVMTQTPSSQAVSAGEKVTMSCKSSQSLLYSENKKNYLAWYQQKPGQSPKLLIFWASTRESGVPDRFIGSGSGTDFTLTISSVQAEDLAVYYCQQYYNFPTFGSGTKLEIKGGGGSGGGGSGGGGSGGGGSEVQLVESGGGLVQPGRSLKLSCAASGFTFRDYYMAWVRQAPKKGLEWVASISYEGNPYYGDSVKGRFTISRNNAKSTLYLQMNSLRSEDTATYYCARHDHNNVDWFAYWGQGTLVTVSSGSHHHHHHHH

SEQ ID NO: 852 - DNA, 1485 bp, Artificial Sequence
  Description of Artificial Sequence: Synthetic polynucleotide
atggccctccctgtcaccgccctgctgcttccgctggctcttctgctccacgccgctcggcccgacatcgtgatgactcagactccaagcagccaggccgtgtccgccggagagaaagtcaccatgtcgtgcaagagctcccagtccctgctgtactccgaaaacaagaagaattatctcgcctggtaccagcagaagcctggacagtccccgaagctcctgatcttttgggcgtcgaccagggaatccggcgtgcccgatcgcttcattggctccggttccggcaccgacttcaccctgaccattagcagcgtccaggcggaggacctggctgtgtactactgccaacagtactacaacttccccactttcggatcggggaccaagctggagatcaagggcggtggaggctcaggggggggcggctcgggagggggtggaagcggaggaggaggctccgaagtgcagcttgtggagtctggcggcggtctggtgcagccgggaagatccctgaagctgtcatgcgccgcgtccgggtttaccttccgcgattactacatggcctgggtcagacaggcacctaagaaggggctggaatgggtggcatccatctcatatgaaggaaacccgtactacggagactcggtgaaaggccgcttcactatctcacggaacaacgctaagagcacgctgtacttgcaaatgaactccctccggtcggaggacacagccacttactactgtgcccggcacgaccataacaacgtcgattggttcgcctactggggtcaaggaaccctcgtgaccgtgtcctccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 853 - protein, 495 aa, Artificial Sequence
  Description of Artificial Sequence: Synthetic polypeptide
MALPVTALLLPLALLLHAARPDIVMTQTPSSQAVSAGEKVTMSCKSSQSLLYSENKKNYLAWYQQKPGQSPKLLIFWASTRESGVPDRFIGSGSGTDFTLTISSVQAEDLAVYYCQQYYNFPTFGSGTKLEIKGGGGSGGGGSGGGGSGGGGSEVQLVESGGGLVQPGRSLKLSCAASGFTFRDYYMAWVRQAPKKGLEWVASISYEGNPYYGDSVKGRFTISRNNAKSTLYLQMNSLRSEDTATYYCARHDHNNVDWFAYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 854 - protein, 248 aa, Artificial Sequence
  Description of Artificial Sequence: Synthetic polypeptide
DIQMTQSPPSLSASLGDKVTITCQASQNINKYIAWYQQKPGKAPRLLIRYTSTLESGTPSRFSGSGSGRDYSFSISNVESGDVASYYCLQYDDLPYTFGPGTKLELKGGGGSGGGGSGGGGSGGGGSEVQLVESGGGLVQPGTSLKLSCVASGFTFSSSGMQWIRQAPKKGLEWISGIYYDSYKKSYADSVKGRFTISRDNSKNTLYLEMNSLRSEDTATYYCAKSAYYGYKDYFDYWGQGVMVTVSS

SEQ ID NO: 855 - DNA, 744 bp, Artificial Sequence
  Description of Artificial Sequence: Synthetic polynucleotide
gacatccaaatgacacagtcacccccttctctttccgcgagcctgggagataaggtcaccattacgtgccaagcgtcccagaacatcaacaagtacatcgcctggtaccagcagaaaccgggaaaggccccgcggctgctgattagatacacctcgactctggaatccggcactccatcaagattcagcggctccggcagcgggagggactactcgttctccatctccaatgtggagtccggggacgtggccagctactattgcctgcaatacgacgatctgccctacaccttcggacctggaaccaagctggaactcaagggcggtggaggctcaggggggggcggctcgggagggggtggaagcggaggaggaggctccgaggtccagcttgtggaatcaggaggcggactcgtccagccgggtactagcctgaagctcagctgtgtggccagcggttttaccttctcgtcctccgggatgcagtggattcggcaggctcccaagaagggactggaatggatctcgggcatctactacgactcgtacaagaagtcctacgccgattccgtgaaaggtcgcttcaccatctcccgggacaacagcaagaacactctgtacctcgagatgaactccttgcgctccgaggataccgcaacctattactgcgccaagtcggcctactacggctacaaggactacttcgactattggggccagggagtgatggtgaccgtgtcctcc

SEQ ID NO: 856 - DNA, 837 bp, Artificial Sequence
  Description of Artificial Sequence: Synthetic polynucleotide
atggccctccctgtcaccgccctgctgcttccgctggctcttctgctccacgccgctcggcccgacatccaaatgacacagtcacccccttctctttccgcgagcctgggagataaggtcaccattacgtgccaagcgtcccagaacatcaacaagtacatcgcctggtaccagcagaaaccgggaaaggccccgcggctgctgattagatacacctcgactctggaatccggcactccatcaagattcagcggctccggcagcgggagggactactcgttctccatctccaatgtggagtccggggacgtggccagctactattgcctgcaatacgacgatctgccctacaccttcggacctggaaccaagctggaactcaagggcggtggaggctcaggggggggcggctcgggagggggtggaagcggaggaggaggctccgaggtccagcttgtggaatcaggaggcggactcgtccagccgggtactagcctgaagctcagctgtgtggccagcggttttaccttctcgtcctccgggatgcagtggattcggcaggctcccaagaagggactggaatggatctcgggcatctactacgactcgtacaagaagtcctacgccgattccgtgaaaggtcgcttcaccatctcccgggacaacagcaagaacactctgtacctcgagatgaactccttgcgctccgaggataccgcaacctattactgcgccaagtcggcctactacggctacaaggactacttcgactattggggccagggagtgatggtgaccgtgtcctccggatcgcaccaccatcaccatcatcatcac

SEQ ID NO: 857 - protein, 279 aa, Artificial Sequence
  Description of Artificial Sequence: Synthetic polypeptide
MALPVTALLLPLALLLHAARPDIQMTQSPPSLSASLGDKVTITCQASQNINKYIAWYQQKPGKAPRLLIRYTSTLESGTPSRFSGSGSGRDYSFSISNVESGDVASYYCLQYDDLPYTFGPGTKLELKGGGGSGGGGSGGGGSGGGGSEVQLVESGGGLVQPGTSLKLSCVASGFTFSSSGMQWIRQAPKKGLEWISGIYYDSYKKSYADSVKGRFTISRDNSKNTLYLEMNSLRSEDTATYYCAKSAYYGYKDYFDYWGQGVMVTVSSGSHHHHHHHH

SEQ ID NO: 858 - DNA, 1476 bp, Artificial Sequence
  Description of Artificial Sequence: Synthetic polynucleotide
atggccctccctgtcaccgccctgctgcttccgctggctcttctgctccacgccgctcggcccgacatccaaatgacacagtcacccccttctctttccgcgagcctgggagataaggtcaccattacgtgccaagcgtcccagaacatcaacaagtacatcgcctggtaccagcagaaaccgggaaaggccccgcggctgctgattagatacacctcgactctggaatccggcactccatcaagattcagcggctccggcagcgggagggactactcgttctccatctccaatgtggagtccggggacgtggccagctactattgcctgcaatacgacgatctgccctacaccttcggacctggaaccaagctggaactcaagggcggtggaggctcaggggggggcggctcgggagggggtggaagcggaggaggaggctccgaggtccagcttgtggaatcaggaggcggactcgtccagccgggtactagcctgaagctcagctgtgtggccagcggttttaccttctcgtcctccgggatgcagtggattcggcaggctcccaagaagggactggaatggatctcgggcatctactacgactcgtacaagaagtcctacgccgattccgtgaaaggtcgcttcaccatctcccgggacaacagcaagaacactctgtacctcgagatgaactccttgcgctccgaggataccgcaacctattactgcgccaagtcggcctactacggctacaaggactacttcgactattggggccagggagtgatggtgaccgtgtcctccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 859 - protein, 492 aa, Artificial Sequence
  Description of Artificial Sequence: Synthetic polypeptide
MALPVTALLLPLALLLHAARPDIQMTQSPPSLSASLGDKVTITCQASQNINKYIAWYQQKPGKAPRLLIRYTSTLESGTPSRFSGSGSGRDYSFSISNVESGDVASYYCLQYDDLPYTFGPGTKLELKGGGGSGGGGSGGGGSGGGGSEVQLVESGGGLVQPGTSLKLSCVASGFTFSSSGMQWIRQAPKKGLEWISGIYYDSYKKSYADSVKGRFTISRDNSKNTLYLEMNSLRSEDTATYYCAKSAYYGYKDYFDYWGQGVMVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 860 - protein, 255 aa, Artificial Sequence
  Description of Artificial Sequence: Synthetic polypeptide
DIVMTQTPSSQAVSAGEKVTMSCKSSQSLLYSENKKNYLAWYQQKPGQSPKLLIYWASTRESGVPDRFIGSGSGTDFTLTISSVQAEDLAVYYCQQYYNFPPWTFGGGTKLELKGGGGSGGGGSGGGGSGGGGSQIQLVQSGPELKKPGESVKISCKTSEYTFTDYAFHWVKQAPGKGLKWMGWINTYSGKPTYADDFKGRFVFSLEDSARTANLQISNLKNEDTATYFCARGAYYGYRDWFTYWGQGTLVTVSS

SEQ ID NO: 861 - DNA, 765 bp, Artificial Sequence
  Description of Artificial Sequence: Synthetic polynucleotide
gatattgtgatgacccagaccccgtcgagccaggcagtgtccgctggagaaaaggtcaccatgtcctgcaagagctcacagtccctgttgtactccgaaaacaagaagaattacctggcctggtaccagcagaagcccggacagtcccctaaactgctgatctactgggcctcgactagggaatctggcgtgcccgaccgctttatcggaagcggttcagggactgacttcaccctgaccattagcagcgtgcaggccgaggacctggcggtgtactactgtcaacagtactacaacttcccgccctggactttcggcggtggaacgaagctcgaactcaagggcggtggaggctcaggggggggcggctcgggagggggtggaagcggaggaggaggctcccaaattcaactggtccagtccggccctgagctgaagaagccgggagaatccgtgaagatctcctgcaagacctcggagtacaccttcactgactacgccttccactgggtcaagcaggcacctgggaaaggcctgaagtggatgggctggatcaacacttactcggggaagccaacctacgccgatgatttcaagggaagattcgtgtttagcctggaggactccgcccggacagctaacctccaaatctccaaccttaagaacgaggacactgcgacctacttctgcgcgcggggagcctattacggttatcgcgactggttcacctactggggacagggcaccctcgtgaccgtgtcctcc

SEQ ID NO: 862 - DNA, 858 bp, Artificial Sequence
  Description of Artificial Sequence: Synthetic polynucleotide
atggccctccctgtcaccgccctgctgcttccgctggctcttctgctccacgccgctcggcccgatattgtgatgacccagaccccgtcgagccaggcagtgtccgctggagaaaaggtcaccatgtcctgcaagagctcacagtccctgttgtactccgaaaacaagaagaattacctggcctggtaccagcagaagcccggacagtcccctaaactgctgatctactgggcctcgactagggaatctggcgtgcccgaccgctttatcggaagcggttcagggactgacttcaccctgaccattagcagcgtgcaggccgaggacctggcggtgtactactgtcaacagtactacaacttcccgccctggactttcggcggtggaacgaagctcgaactcaagggcggtggaggctcaggggggggcggctcgggagggggtggaagcggaggaggaggctcccaaattcaactggtccagtccggccctgagctgaagaagccgggagaatccgtgaagatctcctgcaagacctcggagtacaccttcactgactacgccttccactgggtcaagcaggcacctgggaaaggcctgaagtggatgggctggatcaacacttactcggggaagccaacctacgccgatgatttcaagggaagattcgtgtttagcctggaggactccgcccggacagctaacctccaaatctccaaccttaagaacgaggacactgcgacctacttctgcgcgcggggagcctattacggttatcgcgactggttcacctactggggacagggcaccctcgtgaccgtgtcctccggatcgcaccaccatcaccatcatcatcac

SEQ ID NO: 863 - protein, 286 aa, Artificial Sequence
  Description of Artificial Sequence: Synthetic polypeptide
MALPVTALLLPLALLLHAARPDIVMTQTPSSQAVSAGEKVTMSCKSSQSLLYSENKKNYLAWYQQKPGQSPKLLIYWASTRESGVPDRFIGSGSGTDFTLTISSVQAEDLAVYYCQQYYNFPPWTFGGGTKLELKGGGGSGGGGSGGGGSGGGGSQIQLVQSGPELKKPGESVKISCKTSEYTFTDYAFHWVKQAPGKGLKWMGWINTYSGKPTYADDFKGRFVFSLEDSARTANLQISNLKNEDTATYFCARGAYYGYRDWFTYWGQGTLVTVSSGSHHHHHHHH

SEQ ID NO: 864 - DNA, 1497 bp, Artificial Sequence
  Description of Artificial Sequence: Synthetic polynucleotide
atggccctccctgtcaccgccctgctgcttccgctggctcttctgctccacgccgctcggcccgatattgtgatgacccagaccccgtcgagccaggcagtgtccgctggagaaaaggtcaccatgtcctgcaagagctcacagtccctgttgtactccgaaaacaagaagaattacctggcctggtaccagcagaagcccggacagtcccctaaactgctgatctactgggcctcgactagggaatctggcgtgcccgaccgctttatcggaagcggttcagggactgacttcaccctgaccattagcagcgtgcaggccgaggacctggcggtgtactactgtcaacagtactacaacttcccgccctggactttcggcggtggaacgaagctcgaactcaagggcggtggaggctcaggggggggcggctcgggagggggtggaagcggaggaggaggctcccaaattcaactggtccagtccggccctgagctgaagaagccgggagaatccgtgaagatctcctgcaagacctcggagtacaccttcactgactacgccttccactgggtcaagcaggcacctgggaaaggcctgaagtggatgggctggatcaacacttactcggggaagccaacctacgccgatgatttcaagggaagattcgtgtttagcctggaggactccgcccggacagctaacctccaaatctccaaccttaagaacgaggacactgcgacctacttctgcgcgcggggagcctattacggttatcgcgactggttcacctactggggacagggcaccctcgtgaccgtgtcctccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 865 - protein, 499 aa, Artificial Sequence
  Description of Artificial Sequence: Synthetic polypeptide
MALPVTALLLPLALLLHAARPDIVMTQTPSSQAVSAGEKVTMSCKSSQSLLYSENKKNYLAWYQQKPGQSPKLLIYWASTRESGVPDRFIGSGSGTDFTLTISSVQAEDLAVYYCQQYYNFPPWTFGGGTKLELKGGGGSGGGGSGGGGSGGGGSQIQLVQSGPELKKPGESVKISCKTSEYTFTDYAFHWVKQAPGKGLKWMGWINTYSGKPTYADDFKGRFVFSLEDSARTANLQISNLKNEDTATYFCARGAYYGYRDWFTYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 866 - protein, 248 aa, Artificial Sequence
  Description of Artificial Sequence: Synthetic polypeptide
QVVLTQPKSVSTSLESTVKLSCKINSGNIGSYFIHWYQQHEGRSPTTMIYRDDKRPHGVPDRFSGSIDSSSNSAFLTINNVQTEDEAIYFCHSYDSGINIVFGGGTKLTVLGGGGSGGGGSGGGGSGGGGSEVQLVESGGGLVQPGRSLKLSCLASGFTFSKYGMNWIRQAPGKGLEWVASISSTSIYIYYADTVKGRFTISRENAKNTLYLQMTSLRSEDTALYYCARHDYSSYSYWGQGVMVTVSS

SEQ ID NO: 867 - DNA, 744 bp, Artificial Sequence
  Description of Artificial Sequence: Synthetic polynucleotide
caagtcgtgctgacgcaacccaagtccgtgagcaccagcctggagagcaccgtgaagctcagctgcaagattaactcgggcaacattgggtcctacttcatccattggtaccagcagcacgaaggacggtcccctaccactatgatctaccgggacgacaagcggccgcacggagtgccggacagattctcgggttcaatcgattcctcatctaactcggcgtttctcaccatcaacaacgtgcagaccgaggacgaagcgatctacttctgccactcctacgactcgggtattaacattgtgttcggcggcgggactaagctgacagtgctgggcggtggaggctcaggggggggcggctcgggagggggtggaagcggaggaggaggctccgaggtgcagctcgtcgaatccggtggaggactggtgcagccaggaagatccctgaagctgtcctgtctcgcctcgggcttcactttctccaaatacggcatgaattggattcgccaggcacccggaaaggggctggaatgggtggccagcatcagctcgactagcatctacatctactatgccgataccgtcaagggccgcttcactatctcccgcgagaacgctaagaacaccctttacttgcaaatgacctccctgaggtccgaagataccgccctgtactattgcgcccggcacgactactcatcctactcctactggggacagggagtcatggtgaccgtgtcctcc

SEQ ID NO: 868 - DNA, 837 bp, Artificial Sequence
  Description of Artificial Sequence: Synthetic polynucleotide
atggccctccctgtcaccgccctgctgcttccgctggctcttctgctccacgccgctcggccccaagtcgtgctgacgcaacccaagtccgtgagcaccagcctggagagcaccgtgaagctcagctgcaagattaactcgggcaacattgggtcctacttcatccattggtaccagcagcacgaaggacggtcccctaccactatgatctaccgggacgacaagcggccgcacggagtgccggacagattctcgggttcaatcgattcctcatctaactcggcgtttctcaccatcaacaacgtgcagaccgaggacgaagcgatctacttctgccactcctacgactcgggtattaacattgtgttcggcggcgggactaagctgacagtgctgggcggtggaggctcaggggggggcggctcgggagggggtggaagcggaggaggaggctccgaggtgcagctcgtcgaatccggtggaggactggtgcagccaggaagatccctgaagctgtcctgtctcgcctcgggcttcactttctccaaatacggcatgaattggattcgccaggcacccggaaaggggctggaatgggtggccagcatcagctcgactagcatctacatctactatgccgataccgtcaagggccgcttcactatctcccgcgagaacgctaagaacaccctttacttgcaaatgacctccctgaggtccgaagataccgccctgtactattgcgcccggcacgactactcatcctactcctactggggacagggagtcatggtgaccgtgtcctccggatcgcaccaccatcaccatcatcatcac

SEQ ID NO: 869 - protein, 279 aa, Artificial Sequence
  Description of Artificial Sequence: Synthetic polypeptide
MALPVTALLLPLALLLHAARPQVVLTQPKSVSTSLESTVKLSCKINSGNIGSYFIHWYQQHEGRSPTTMIYRDDKRPHGVPDRFSGSIDSSSNSAFLTINNVQTEDEAIYFCHSYDSGINIVFGGGTKLTVLGGGGSGGGGSGGGGSGGGGSEVQLVESGGGLVQPGRSLKLSCLASGFTFSKYGMNWIRQAPGKGLEWVASISSTSIYIYYADTVKGRFTISRENAKNTLYLQMTSLRSEDTALYYCARHDYSSYSYWGQGVMVTVSSGSHHHHHHHH

SEQ ID NO: 870 - DNA, 1476 bp, Artificial Sequence
  Description of Artificial Sequence: Synthetic polynucleotide
atggccctccctgtcaccgccctgctgcttccgctggctcttctgctccacgccgctcggccccaagtcgtgctgacgcaacccaagtccgtgagcaccagcctggagagcaccgtgaagctcagctgcaagattaactcgggcaacattgggtcctacttcatccattggtaccagcagcacgaaggacggtcccctaccactatgatctaccgggacgacaagcggccgcacggagtgccggacagattctcgggttcaatcgattcctcatctaactcggcgtttctcaccatcaacaacgtgcagaccgaggacgaagcgatctacttctgccactcctacgactcgggtattaacattgtgttcggcggcgggactaagctgacagtgctgggcggtggaggctcaggggggggcggctcgggagggggtggaagcggaggaggaggctccgaggtgcagctcgtcgaatccggtggaggactggtgcagccaggaagatccctgaagctgtcctgtctcgcctcgggcttcactttctccaaatacggcatgaattggattcgccaggcacccggaaaggggctggaatgggtggccagcatcagctcgactagcatctacatctactatgccgataccgtcaagggccgcttcactatctcccgcgagaacgctaagaacaccctttacttgcaaatgacctccctgaggtccgaagataccgccctgtactattgcgcccggcacgactactcatcctactcctactggggacagggagtcatggtgaccgtgtcctccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 871 - protein, 492 aa, Artificial Sequence
  Description of Artificial Sequence: Synthetic polypeptide
MALPVTALLLPLALLLHAARPQVVLTQPKSVSTSLESTVKLSCKINSGNIGSYFIHWYQQHEGRSPTTMIYRDDKRPHGVPDRFSGSIDSSSNSAFLTINNVQTEDEAIYFCHSYDSGINIVFGGGTKLTVLGGGGSGGGGSGGGGSGGGGSEVQLVESGGGLVQPGRSLKLSCLASGFTFSKYGMNWIRQAPGKGLEWVASISSTSIYIYYADTVKGRFTISRENAKNTLYLQMTSLRSEDTALYYCARHDYSSYSYWGQGVMVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 872 - protein, 251 aa, Artificial Sequence
  Description of Artificial Sequence: Synthetic polypeptide
DVQMTQSPSLLSASVGDAVTINCKASQNINRYLNWYQQKLGEGPRLLIYSANSLQTGIPSRFSGSGSGADFTLTITSPQPEDVATYFCLQHNSWPLTFGSGTKLEIKGGGGSGGGGSGGGGSGGGGSQVTLKESGPGILQPSQTLSLTCTFTRFSLSTYGMSVGWIRQPSGKGLEWLADIWWDDDKHYNPSLKNRLTISKDTSKNQAFLKITNVDTADTATYYCARSSTTDGIVTYVMDVWGQGASVTVSS

SEQ ID NO: 873 - DNA, 753 bp, Artificial Sequence
  Description of Artificial Sequence: Synthetic polynucleotide
gacgtgcagatgactcagtccccgtcgctcctgtccgcctccgtcggcgacgccgtgactattaactgcaaggcgtcccagaacatcaatcggtacctgaactggtaccagcaaaaactgggagaagggccgagacttctcatctactccgccaactccctgcaaactggcatcccgtcgaggttcagcggatcaggctctggtgccgacttcactttgaccatcacgagccctcagcccgaagatgtggccacctacttctgcctccaacacaactcctggcccctgacctttggttcgggcaccaagctggagatcaagggcggtggaggctcaggggggggcggctcgggagggggtggaagcggaggaggaggctcccaagtcacgctgaaggaatcgggccctggaattctgcagccaagccagaccctctcgcttacttgcaccttcacccgcttctcactgtccacttacggaatgtccgtgggatggattcggcagcccagcggaaagggtttggagtggctggccgacatttggtgggatgacgacaagcattacaaccctagcctgaagaatcggctcaccatcagcaaagacacctccaagaaccaggcgttcctgaagatcaccaacgtggataccgccgacactgcaacatactattgtgcccgctcctcaaccaccgatgggatcgtgacctacgtgatggacgtctggggccagggagcttccgtgaccgtgtcctcc

SEQ ID NO: 874 - DNA, 846 bp, Artificial Sequence
  Description of Artificial Sequence: Synthetic polynucleotide
atggccctccctgtcaccgccctgctgcttccgctggctcttctgctccacgccgctcggcccgacgtgcagatgactcagtccccgtcgctcctgtccgcctccgtcggcgacgccgtgactattaactgcaaggcgtcccagaacatcaatcggtacctgaactggtaccagcaaaaactgggagaagggccgagacttctcatctactccgccaactccctgcaaactggcatcccgtcgaggttcagcggatcaggctctggtgccgacttcactttgaccatcacgagccctcagcccgaagatgtggccacctacttctgcctccaacacaactcctggcccctgacctttggttcgggcaccaagctggagatcaagggcggtggaggctcaggggggggcggctcgggagggggtggaagcggaggaggaggctcccaagtcacgctgaaggaatcgggccctggaattctgcagccaagccagaccctctcgcttacttgcaccttcacccgcttctcactgtccacttacggaatgtccgtgggatggattcggcagcccagcggaaagggtttggagtggctggccgacatttggtgggatgacgacaagcattacaaccctagcctgaagaatcggctcaccatcagcaaagacacctccaagaaccaggcgttcctgaagatcaccaacgtggataccgccgacactgcaacatactattgtgcccgctcctcaaccaccgatgggatcgtgacctacgtgatggacgtctggggccagggagcttccgtgaccgtgtcctccggatcgcaccaccatcaccatcatcatcac

SEQ ID NO: 875 - protein, 282 aa, Artificial Sequence
  Description of Artificial Sequence: Synthetic polypeptide
MALPVTALLLPLALLLHAARPDVQMTQSPSLLSASVGDAVTINCKASQNINRYLNWYQQKLGEGPRLLIYSANSLQTGIPSRFSGSGSGADFTLTITSPQPEDVATYFCLQHNSWPLTFGSGTKLEIKGGGGSGGGGSGGGGSGGGGSQVTLKESGPGILQPSQTLSLTCTFTRFSLSTYGMSVGWIRQPSGKGLEWLADIWWDDDKHYNPSLKNRLTISKDTSKNQAFLKITNVDTADTATYYCARSSTTDGIVTYVMDVWGQGASVTVSSGSHHHHHHHH

SEQ ID NO: 876 - DNA, 1485 bp, Artificial Sequence
  Description of Artificial Sequence: Synthetic polynucleotide
atggccctccctgtcaccgccctgctgcttccgctggctcttctgctccacgccgctcggcccgacgtgcagatgactcagtccccgtcgctcctgtccgcctccgtcggcgacgccgtgactattaactgcaaggcgtcccagaacatcaatcggtacctgaactggtaccagcaaaaactgggagaagggccgagacttctcatctactccgccaactccctgcaaactggcatcccgtcgaggttcagcggatcaggctctggtgccgacttcactttgaccatcacgagccctcagcccgaagatgtggccacctacttctgcctccaacacaactcctggcccctgacctttggttcgggcaccaagctggagatcaagggcggtggaggctcaggggggggcggctcgggagggggtggaagcggaggaggaggctcccaagtcacgctgaaggaatcgggccctggaattctgcagccaagccagaccctctcgcttacttgcaccttcacccgcttctcactgtccacttacggaatgtccgtgggatggattcggcagcccagcggaaagggtttggagtggctggccgacatttggtgggatgacgacaagcattacaaccctagcctgaagaatcggctcaccatcagcaaagacacctccaagaaccaggcgttcctgaagatcaccaacgtggataccgccgacactgcaacatactattgtgcccgctcctcaaccaccgatgggatcgtgacctacgtgatggacgtctggggccagggagcttccgtgaccgtgtcctccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 877 - protein, 495 aa, Artificial Sequence
  Description of Artificial Sequence: Synthetic polypeptide
MALPVTALLLPLALLLHAARPDVQMTQSPSLLSASVGDAVTINCKASQNINRYLNWYQQKLGEGPRLLIYSANSLQTGIPSRFSGSGSGADFTLTITSPQPEDVATYFCLQHNSWPLTFGSGTKLEIKGGGGSGGGGSGGGGSGGGGSQVTLKESGPGILQPSQTLSLTCTFTRFSLSTYGMSVGWIRQPSGKGLEWLADIWWDDDKHYNPSLKNRLTISKDTSKNQAFLKITNVDTADTATYYCARSSTTDGIVTYVMDVWGQGASVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 878 - protein, 250 aa, Artificial Sequence
  Description of Artificial Sequence: Synthetic polypeptide
DIQMTQSPSFLSASVGDRVTINCKASQNINRYLNWYQQKLGEAPKLLIYNANSLQTGIPSRFSGSGSGTDFTLTISSLQPADVATYFCLQHNSRPLTFGSGTILEIKGGGGSGGGGSGGGGSGGGGSQVTLKESGPGLLQPSQTLSLTCTFAGFSLNTHGMGVGWIRQPSGKGLEWLANIWWDDDKYYNPSLKNRLTMSKDTSNNQAFLKITNVDTADTATYYCARIEGSPVVTTVFDYWGQGVMVTVSS

SEQ ID NO: 879 - DNA, 750 bp, Artificial Sequence
  Description of Artificial Sequence: Synthetic polynucleotide
gacatccaaatgacccagtcacctagctttctgtcggcctcggtcggcgacagagtgaccattaactgcaaagcgtcccagaacatcaaccgctacctgaattggtaccagcagaagctgggggaagccccgaagctgctgatctacaacgcgaacagcctccagactggtattccttcccggttctccgggagcggctcgggtaccgatttcaccctcaccatctcctcccttcaacccgctgacgtggccacctacttctgcttgcaacataattctcggcctctgaccttcggaagcggcactatcctcgagatcaagggcggtggaggctcaggggggggcggctcgggagggggtggaagcggaggaggaggctcccaagtcactcttaaggaatccgggccaggactgttgcagccgagccagaccctgtccctcacttgtaccttcgccggcttttcactgaacacccacggaatgggcgtgggatggattaggcagccctcgggaaagggactggagtggctggccaacatttggtgggacgacgacaagtattacaacccgagcctcaagaaccgcctgactatgtccaaggatacctccaacaaccaggccttcctgaaaatcactaacgtggataccgctgacaccgcaacgtactactgcgcccggatcgaaggttcccccgtcgtgacaactgtgttcgactactggggacagggcgtgatggtgaccgtgtcctcc

SEQ ID NO: 880 - DNA, 843 bp, Artificial Sequence
  Description of Artificial Sequence: Synthetic polynucleotide
atggccctccctgtcaccgccctgctgcttccgctggctcttctgctccacgccgctcggcccgacatccaaatgacccagtcacctagctttctgtcggcctcggtcggcgacagagtgaccattaactgcaaagcgtcccagaacatcaaccgctacctgaattggtaccagcagaagctgggggaagccccgaagctgctgatctacaacgcgaacagcctccagactggtattccttcccggttctccgggagcggctcgggtaccgatttcaccctcaccatctcctcccttcaacccgctgacgtggccacctacttctgcttgcaacataattctcggcctctgaccttcggaagcggcactatcctcgagatcaagggcggtggaggctcaggggggggcggctcgggagggggtggaagcggaggaggaggctcccaagtcactcttaaggaatccgggccaggactgttgcagccgagccagaccctgtccctcacttgtaccttcgccggcttttcactgaacacccacggaatgggcgtgggatggattaggcagccctcgggaaagggactggagtggctggccaacatttggtgggacgacgacaagtattacaacccgagcctcaagaaccgcctgactatgtccaaggatacctccaacaaccaggccttcctgaaaatcactaacgtggataccgctgacaccgcaacgtactactgcgcccggatcgaaggttcccccgtcgtgacaactgtgttcgactactggggacagggcgtgatggtgaccgtgtcctccggatcgcaccaccatcaccatcatcatcac

SEQ ID NO: 881 - protein, 281 aa, Artificial Sequence
  Description of Artificial Sequence: Synthetic polypeptide
MALPVTALLLPLALLLHAARPDIQMTQSPSFLSASVGDRVTINCKASQNINRYLNWYQQKLGEAPKLLIYNANSLQTGIPSRFSGSGSGTDFTLTISSLQPADVATYFCLQHNSRPLTFGSGTILEIKGGGGSGGGGSGGGGSGGGGSQVTLKESGPGLLQPSQTLSLTCTFAGFSLNTHGMGVGWIRQPSGKGLEWLANIWWDDDKYYNPSLKNRLTMSKDTSNNQAFLKITNVDTADTATYYCARIEGSPVVTTVFDYWGQGVMVTVSSGSHHHHHHHH

SEQ ID NO: 882 - DNA, 1482 bp, Artificial Sequence
  Description of Artificial Sequence: Synthetic polynucleotide
atggccctccctgtcaccgccctgctgcttccgctggctcttctgctccacgccgctcggcccgacatccaaatgacccagtcacctagctttctgtcggcctcggtcggcgacagagtgaccattaactgcaaagcgtcccagaacatcaaccgctacctgaattggtaccagcagaagctgggggaagccccgaagctgctgatctacaacgcgaacagcctccagactggtattccttcccggttctccgggagcggctcgggtaccgatttcaccctcaccatctcctcccttcaacccgctgacgtggccacctacttctgcttgcaacataattctcggcctctgaccttcggaagcggcactatcctcgagatcaagggcggtggaggctcaggggggggcggctcgggagggggtggaagcggaggaggaggctcccaagtcactcttaaggaatccgggccaggactgttgcagccgagccagaccctgtccctcacttgtaccttcgccggcttttcactgaacacccacggaatgggcgtgggatggattaggcagccctcgggaaagggactggagtggctggccaacatttggtgggacgacgacaagtattacaacccgagcctcaagaaccgcctgactatgtccaaggatacctccaacaaccaggccttcctgaaaatcactaacgtggataccgctgacaccgcaacgtactactgcgcccggatcgaaggttcccccgtcgtgacaactgtgttcgactactggggacagggcgtgatggtgaccgtgtcctccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 883 - protein, 494 aa, Artificial Sequence
  Description of Artificial Sequence: Synthetic polypeptide
MALPVTALLLPLALLLHAARPDIQMTQSPSFLSASVGDRVTINCKASQNINRYLNWYQQKLGEAPKLLIYNANSLQTGIPSRFSGSGSGTDFTLTISSLQPADVATYFCLQHNSRPLTFGSGTILEIKGGGGSGGGGSGGGGSGGGGSQVTLKESGPGLLQPSQTLSLTCTFAGFSLNTHGMGVGWIRQPSGKGLEWLANIWWDDDKYYNPSLKNRLTMSKDTSNNQAFLKITNVDTADTATYYCARIEGSPVVTTVFDYWGQGVMVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 884 - protein, 248 aa, Artificial Sequence
  Description of Artificial Sequence: Synthetic polypeptide
KIVLTQSPTITAASPGEKVTITCLASSRVSNIYWYQQKSGASPKLLIYSTSSLASGVPYRFSGSGSGTSYSLTINTMEAEDAATYYCHQWSSNPWTFGGGTKLELKGGGGSGGGGSGGGGSGGGGSQVTLKESGPGMLQPSKTLSLTCSFSGFSLSTSGMVVSWIRQPSGKSLEWLAAIAWDGDKYYNPSLKSRVTVSKDTSNTQVFLRITSVDIADTATYYCTRRDYDVGYYYFDFWGQGVMVTVSS

SEQ ID NO: 885 - DNA, 744 bp, Artificial Sequence
  Description of Artificial Sequence: Synthetic polynucleotide
aagattgtgctgacccagagccccactattaccgccgcctccccgggggaaaaggtcaccatcacttgtctggcgtcctcacgcgtgtcgaatatctactggtatcagcagaagtccggcgccagccccaagctgctgatctactcgacctcctccctcgcgtcgggagtgccttaccggttttctggctcgggaagcggaaccagctactccttgaccatcaacaccatggaagccgaggacgctgccacttactactgccaccagtggtcgagcaacccttggactttcggtggaggcaccaaactcgagctcaagggcggtggaggctcaggggggggcggctcgggagggggtggaagcggaggaggaggctcccaagtcaccctgaaagaatcgggtcccggaatgctgcagccatccaagacgctgtcccttacatgctccttctccgggttcagcctctcaacttccgggatggtggtgtcatggatcagacagccgagcggaaagtccctggagtggctggcggccatcgcatgggatggcgataagtactacaacccgagcctgaagtcaagggtcactgtgtccaaggacacctccaacacccaagtgttccttcggatcacctccgtggacattgctgacaccgccacctattactgcactcgccgggactacgacgtgggctactactacttcgatttctggggacagggtgtcatggtgaccgtgtcctcc

SEQ ID NO: 886 - DNA, 837 bp, Artificial Sequence
  Description of Artificial Sequence: Synthetic polynucleotide
atggccctccctgtcaccgccctgctgcttccgctggctcttctgctccacgccgctcggcccaagattgtgctgacccagagccccactattaccgccgcctccccgggggaaaaggtcaccatcacttgtctggcgtcctcacgcgtgtcgaatatctactggtatcagcagaagtccggcgccagccccaagctgctgatctactcgacctcctccctcgcgtcgggagtgccttaccggttttctggctcgggaagcggaaccagctactccttgaccatcaacaccatggaagccgaggacgctgccacttactactgccaccagtggtcgagcaacccttggactttcggtggaggcaccaaactcgagctcaagggcggtggaggctcaggggggggcggctcgggagggggtggaagcggaggaggaggctcccaagtcaccctgaaagaatcgggtcccggaatgctgcagccatccaagacgctgtcccttacatgctccttctccgggttcagcctctcaacttccgggatggtggtgtcatggatcagacagccgagcggaaagtccctggagtggctggcggccatcgcatgggatggcgataagtactacaacccgagcctgaagtcaagggtcactgtgtccaaggacacctccaacacccaagtgttccttcggatcacctccgtggacattgctgacaccgccacctattactgcactcgccgggactacgacgtgggctactactacttcgatttctggggacagggtgtcatggtgaccgtgtcctccggatcgcaccaccatcaccatcatcatcac

SEQ ID NO: 887 - protein, 279 aa, Artificial Sequence
  Description of Artificial Sequence: Synthetic polypeptide
MALPVTALLLPLALLLHAARPKIVLTQSPTITAASPGEKVTITCLASSRVSNIYWYQQKSGASPKLLIYSTSSLASGVPYRFSGSGSGTSYSLTINTMEAEDAATYYCHQWSSNPWTFGGGTKLELKGGGGSGGGGSGGGGSGGGGSQVTLKESGPGMLQPSKTLSLTCSFSGFSLSTSGMVVSWIRQPSGKSLEWLAAIAWDGDKYYNPSLKSRVTVSKDTSNTQVFLRITSVDIADTATYYCTRRDYDVGYYYFDFWGQGVMVTVSSGSHHHHHHHH

SEQ ID NO: 888 - DNA, 1476 bp, Artificial Sequence
  Description of Artificial Sequence: Synthetic polynucleotide
atggccctccctgtcaccgccctgctgcttccgctggctcttctgctccacgccgctcggcccaagattgtgctgacccagagccccactattaccgccgcctccccgggggaaaaggtcaccatcacttgtctggcgtcctcacgcgtgtcgaatatctactggtatcagcagaagtccggcgccagccccaagctgctgatctactcgacctcctccctcgcgtcgggagtgccttaccggttttctggctcgggaagcggaaccagctactccttgaccatcaacaccatggaagccgaggacgctgccacttactactgccaccagtggtcgagcaacccttggactttcggtggaggcaccaaactcgagctcaagggcggtggaggctcaggggggggcggctcgggagggggtggaagcggaggaggaggctcccaagtcaccctgaaagaatcgggtcccggaatgctgcagccatccaagacgctgtcccttacatgctccttctccgggttcagcctctcaacttccgggatggtggtgtcatggatcagacagccgagcggaaagtccctggagtggctggcggccatcgcatgggatggcgataagtactacaacccgagcctgaagtcaagggtcactgtgtccaaggacacctccaacacccaagtgttccttcggatcacctccgtggacattgctgacaccgccacctattactgcactcgccgggactacgacgtgggctactactacttcgatttctggggacagggtgtcatggtgaccgtgtcctccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 889 - protein, 492 aa, Artificial Sequence
  Description of Artificial Sequence: Synthetic polypeptide
MALPVTALLLPLALLLHAARPKIVLTQSPTITAASPGEKVTITCLASSRVSNIYWYQQKSGASPKLLIYSTSSLASGVPYRFSGSGSGTSYSLTINTMEAEDAATYYCHQWSSNPWTFGGGTKLELKGGGGSGGGGSGGGGSGGGGSQVTLKESGPGMLQPSKTLSLTCSFSGFSLSTSGMVVSWIRQPSGKSLEWLAAIAWDGDKYYNPSLKSRVTVSKDTSNTQVFLRITSVDIADTATYYCTRRDYDVGYYYFDFWGQGVMVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 890 - protein, 247 aa, Artificial Sequence
  Description of Artificial Sequence: Synthetic polypeptide
NIQLTQSPSRLSASVGDRVTLSCKGSQNINNYLAWYQQKLGEAPKLLIYNTNNLQTGIPSRFSGSGSGTDYTFTISGLQPEDVATYFCCQYNNGNTFGAGTKLELKGGGGSGGGGSGGGGSGGGGSQIQLVQSGPELKKPGESVKISCKASGNTVTGYAMHWVRQAPGKGLKWMGWINTYSGKPTYADDFKGRCVFSLEASASTAHLQISNLKNEDTATYFCARSTYYGYKDWFAYWGQGTLVTVSS

SEQ ID NO: 891 - DNA, 741 bp, Artificial Sequence
  Description of Artificial Sequence: Synthetic polynucleotide
aacatccaactgactcagagccccagccggctgtccgcctccgtgggggacagggtcacactgagctgcaagggttctcagaacatcaacaactacctcgcgtggtaccagcagaagctgggagaggcccccaagctgctcatctacaacaccaacaatctgcaaactggcattccatcgagattctcaggatcagggtccggtaccgactacaccttcacgatttcgggacttcagcctgaggatgtggccacctacttctgctgtcagtacaacaacggcaacaccttcggtgctggcaccaagctggaactcaaaggcggtggaggctcaggggggggcggctcgggagggggtggaagcggaggaggaggctcccaaattcagttggtgcagtccggcccggagctgaagaagcctggagaatccgtgaagatctcgtgcaaagcttccgggaacaccgtgaccggatacgcaatgcactgggtccgccaggcaccgggaaagggactgaagtggatggggtggatcaacacctacagcggaaagccgacttacgccgatgactttaagggacgctgtgtgttctccctggaagcgtccgcctcgactgcccatcttcaaatctccaacctgaagaatgaggacaccgccacttacttctgcgcccggagcacctattacggctacaaggactggttcgcgtattggggccagggcactctcgtgaccgtgtcctcc

SEQ ID NO: 892 - DNA, 834 bp, Artificial Sequence
  Description of Artificial Sequence: Synthetic polynucleotide
atggccctccctgtcaccgccctgctgcttccgctggctcttctgctccacgccgctcggcccaacatccaactgactcagagccccagccggctgtccgcctccgtgggggacagggtcacactgagctgcaagggttctcagaacatcaacaactacctcgcgtggtaccagcagaagctgggagaggcccccaagctgctcatctacaacaccaacaatctgcaaactggcattccatcgagattctcaggatcagggtccggtaccgactacaccttcacgatttcgggacttcagcctgaggatgtggccacctacttctgctgtcagtacaacaacggcaacaccttcggtgctggcaccaagctggaactcaaaggcggtggaggctcaggggggggcggctcgggagggggtggaagcggaggaggaggctcccaaattcagttggtgcagtccggcccggagctgaagaagcctggagaatccgtgaagatctcgtgcaaagcttccgggaacaccgtgaccggatacgcaatgcactgggtccgccaggcaccgggaaagggactgaagtggatggggtggatcaacacctacagcggaaagccgacttacgccgatgactttaagggacgctgtgtgttctccctggaagcgtccgcctcgactgcccatcttcaaatctccaacctgaagaatgaggacaccgccacttacttctgcgcccggagcacctattacggctacaaggactggttcgcgtattggggccagggcactctcgtgaccgtgtcctccggatcgcaccaccatcaccatcatcatcac

SEQ ID NO: 893 - protein, 278 aa, Artificial Sequence
  Description of Artificial Sequence: Synthetic polypeptide
MALPVTALLLPLALLLHAARPNIQLTQSPSRLSASVGDRVTLSCKGSQNINNYLAWYQQKLGEAPKLLIYNTNNLQTGIPSRFSGSGSGTDYTFTISGLQPEDVATYFCCQYNNGNTFGAGTKLELKGGGGSGGGGSGGGGSGGGGSQIQLVQSGPELKKPGESVKISCKASGNTVTGYAMHWVRQAPGKGLKWMGWINTYSGKPTYADDFKGRCVFSLEASASTAHLQISNLKNEDTATYFCARSTYYGYKDWFAYWGQGTLVTVSSGSHHHHHHHH

SEQ ID NO: 894 - DNA, 1473 bp, Artificial Sequence
  Description of Artificial Sequence: Synthetic polynucleotide
atggccctccctgtcaccgccctgctgcttccgctggctcttctgctccacgccgctcggcccaacatccaactgactcagagccccagccggctgtccgcctccgtgggggacagggtcacactgagctgcaagggttctcagaacatcaacaactacctcgcgtggtaccagcagaagctgggagaggcccccaagctgctcatctacaacaccaacaatctgcaaactggcattccatcgagattctcaggatcagggtccggtaccgactacaccttcacgatttcgggacttcagcctgaggatgtggccacctacttctgctgtcagtacaacaacggcaacaccttcggtgctggcaccaagctggaactcaaaggcggtggaggctcaggggggggcggctcgggagggggtggaagcggaggaggaggctcccaaattcagttggtgcagtccggcccggagctgaagaagcctggagaatccgtgaagatctcgtgcaaagcttccgggaacaccgtgaccggatacgcaatgcactgggtccgccaggcaccgggaaagggactgaagtggatggggtggatcaacacctacagcggaaagccgacttacgccgatgactttaagggacgctgtgtgttctccctggaagcgtccgcctcgactgcccatcttcaaatctccaacctgaagaatgaggacaccgccacttacttctgcgcccggagcacctattacggctacaaggactggttcgcgtattggggccagggcactctcgtgaccgtgtcctccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 895 - protein, 491 aa, Artificial Sequence
  Description of Artificial Sequence: Synthetic polypeptide
MALPVTALLLPLALLLHAARPNIQLTQSPSRLSASVGDRVTLSCKGSQNINNYLAWYQQKLGEAPKLLIYNTNNLQTGIPSRFSGSGSGTDYTFTISGLQPEDVATYFCCQYNNGNTFGAGTKLELKGGGGSGGGGSGGGGSGGGGSQIQLVQSGPELKKPGESVKISCKASGNTVTGYAMHWVRQAPGKGLKWMGWINTYSGKPTYADDFKGRCVFSLEASASTAHLQISNLKNEDTATYFCARSTYYGYKDWFAYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 896 - protein, 17 aa, Artificial Sequence
  Description of Artificial Sequence: Synthetic peptide
GIYYDSYKKSYADSVKG

SEQ ID NO: 897 - protein, 17 aa, Artificial Sequence
  Description of Artificial Sequence: Synthetic peptide
WINTYSGKPTYADDFKG

SEQ ID NO: 898 - protein, 17 aa, Artificial Sequence
  Description of Artificial Sequence: Synthetic peptide
SISSTSIYIYYADTVKG

SEQ ID NO: 899 - protein, 16 aa, Artificial Sequence
  Description of Artificial Sequence: Synthetic peptide
DIWWDDDKHYNPSLKN

SEQ ID NO: 900 - protein, 16 aa, Artificial Sequence
  Description of Artificial Sequence: Synthetic peptide
NIWWDDDKYYNPSLKN

SEQ ID NO: 901 - protein, 16 aa, Artificial Sequence
  Description of Artificial Sequence: Synthetic peptide
AIAWDGDKYYNPSLKS

SEQ ID NO: 902 - protein, 17 aa, Artificial Sequence
  Description of Artificial Sequence: Synthetic peptide
WINTYSGKPTYADDFKG

SEQ ID NO: 903 - protein, 5 aa, Artificial Sequence
  Description of Artificial Sequence: Synthetic peptide
DWFTY

SEQ ID NO: 904 - protein, 8 aa, Artificial Sequence
  Description of Artificial Sequence: Synthetic peptide
HDYSSYSY

SEQ ID NO: 905 - protein, 11 aa, Artificial Sequence
  Description of Artificial Sequence: Synthetic peptide
HDHNNVDWFAY

SEQ ID NO: 906 - protein, 14 aa, Artificial Sequence
  Description of Artificial Sequence: Synthetic peptide
SSTTDGIVTYVMDV

SEQ ID NO: 907 - protein, 12 aa, Artificial Sequence
  Description of Artificial Sequence: Synthetic peptide
SAYYGYKDYFDY

SEQ ID NO: 908 - protein, 13 aa, Artificial Sequence
  Description of Artificial Sequence: Synthetic peptide
IEGSPVVTTVFDY

SEQ ID NO: 909 - protein, 12 aa, Artificial Sequence
  Description of Artificial Sequence: Synthetic peptide
RDYDVGYYYFDF

SEQ ID NO: 910 - protein, 5 aa, Artificial Sequence
  Description of Artificial Sequence: Synthetic peptide
DWFAY

SEQ ID NO: 911 - protein, 11 aa, Artificial Sequence
  Description of Artificial Sequence: Synthetic peptide
HDHNNVDWFAY

SEQ ID NO: 912 - protein, 12 aa, Artificial Sequence
  Description of Artificial Sequence: Synthetic peptide
SAYYGYKDYFDY

SEQ ID NO: 913 - protein, 12 aa, Artificial Sequence
  Description of Artificial Sequence: Synthetic peptide
GAYYGYRDWFTY

SEQ ID NO: 914 - protein, 8 aa, Artificial Sequence
  Description of Artificial Sequence: Synthetic peptide
HDYSSYSY

SEQ ID NO: 915 - protein, 14 aa, Artificial Sequence
  Description of Artificial Sequence: Synthetic peptide
SSTTDGIVTYVMDV

SEQ ID NO: 916 - protein, 13 aa, Artificial Sequence
  Description of Artificial Sequence: Synthetic peptide
IEGSPVVTTVFDY

SEQ ID NO: 917 - protein, 12 aa, Artificial Sequence
  Description of Artificial Sequence: Synthetic peptide
RDYDVGYYYFDF

SEQ ID NO: 918 - protein, 12 aa, Artificial Sequence
  Description of Artificial Sequence: Synthetic peptide
STYYGYKDWFAY

SEQ ID NO: 919 - protein, 17 aa, Artificial Sequence
  Description of Artificial Sequence: Synthetic peptide
KSSQSLLYSENKKNYLA

SEQ ID NO: 920 - protein, 13 aa, Artificial Sequence
  Description of Artificial Sequence: Synthetic peptide
KINSGNIGSYFIH

SEQ ID NO: 921 - protein, 17 aa, Artificial Sequence
  Description of Artificial Sequence: Synthetic peptide
KSSQSLLYSENKKNYLA

SEQ ID NO: 922 - protein, 11 aa, Artificial Sequence
  Description of Artificial Sequence: Synthetic peptide
KASQNINRYLN

SEQ ID NO: 923 - protein, 11 aa, Artificial Sequence
  Description of Artificial Sequence: Synthetic peptide
QASQNINKYIA

SEQ ID NO: 924 - protein, 11 aa, Artificial Sequence
  Description of Artificial Sequence: Synthetic peptide
KASQNINRYLN

SEQ ID NO: 925 - protein, 10 aa, Artificial Sequence
  Description of Artificial Sequence: Synthetic peptide
LASSRVSNIY

SEQ ID NO: 926 - protein, 11 aa, Artificial Sequence
  Description of Artificial Sequence: Synthetic peptide
KGSQNINNYLA

SEQ ID NO: 927 - protein, 17 aa, Artificial Sequence
  Description of Artificial Sequence: Synthetic peptide
KSSQSLLYSENKKNYLA

SEQ ID NO: 928 - protein, 11 aa, Artificial Sequence
  Description of Artificial Sequence: Synthetic peptide
QASQNINKYIA

SEQ ID NO: 929 - protein, 17 aa, Artificial Sequence
  Description of Artificial Sequence: Synthetic peptide
KSSQSLLYSENKKNYLA

SEQ ID NO: 930 - protein, 13 aa, Artificial Sequence
  Description of Artificial Sequence: Synthetic peptide
KINSGNIGSYFIH

SEQ ID NO: 931 - protein, 11 aa, Artificial Sequence
  Description of Artificial Sequence: Synthetic peptide
KASQNINRYLN

SEQ ID NO: 932 - protein, 11 aa, Artificial Sequence
  Description of Artificial Sequence: Synthetic peptide
KASQNINRYLN

SEQ ID NO: 933 - protein, 10 aa, Artificial Sequence
  Description of Artificial Sequence: Synthetic peptide
LASSRVSNIY

SEQ ID NO: 934 - protein, 11 aa, Artificial Sequence
  Description of Artificial Sequence: Synthetic peptide
KGSQNINNYLA

SEQ ID NO: 935 - protein, 7 aa, Artificial Sequence
  Description of Artificial Sequence: Synthetic peptide
WASTRES

SEQ ID NO: 936 - protein, 7 aa, Artificial Sequence
  Description of Artificial Sequence: Synthetic peptide
RDDKRPH

SEQ ID NO: 937 - protein, 7 aa, Artificial Sequence
  Description of Artificial Sequence: Synthetic peptide
WASTRES

SEQ ID NO: 938 - protein, 7 aa, Artificial Sequence
  Description of Artificial Sequence: Synthetic peptide
SANSLQT

SEQ ID NO: 939 - protein, 7 aa, Artificial Sequence
  Description of Artificial Sequence: Synthetic peptide
YTSTLES

SEQ ID NO: 940 - protein, 7 aa, Artificial Sequence
  Description of Artificial Sequence: Synthetic peptide
NANSLQT

SEQ ID NO: 941 - protein, 7 aa, Artificial Sequence
  Description of Artificial Sequence: Synthetic peptide
STSSLAS

SEQ ID NO: 942 - protein, 7 aa, Artificial Sequence
  Description of Artificial Sequence: Synthetic peptide
NTNNLQT

SEQ ID NO: 943 - protein, 7 aa, Artificial Sequence
  Description of Artificial Sequence: Synthetic peptide
WASTRES

SEQ ID NO: 944 - protein, 7 aa, Artificial Sequence
  Description of Artificial Sequence: Synthetic peptide
YTSTLES

SEQ ID NO: 945 - protein, 7 aa, Artificial Sequence
  Description of Artificial Sequence: Synthetic peptide
WASTRES

SEQ ID NO: 946 - protein, 7 aa, Artificial Sequence
  Description of Artificial Sequence: Synthetic peptide
RDDKRPH

SEQ ID NO: 947 - protein, 7 aa, Artificial Sequence
  Description of Artificial Sequence: Synthetic peptide
SANSLQT

SEQ ID NO: 948 - protein, 7 aa, Artificial Sequence
  Description of Artificial Sequence: Synthetic peptide
NANSLQT

SEQ ID NO: 949 - protein, 7 aa, Artificial Sequence
  Description of Artificial Sequence: Synthetic peptide
STSSLAS

SEQ ID NO: 950 - protein, 7 aa, Artificial Sequence
  Description of Artificial Sequence: Synthetic peptide
NTNNLQT

SEQ ID NO: 951 - protein, 10 aa, Artificial Sequence
  Description of Artificial Sequence: Synthetic peptide
QQYYNFPPWT

SEQ ID NO: 952 - protein, 10 aa, Artificial Sequence
  Description of Artificial Sequence: Synthetic peptide
HSYDSGINIV

SEQ ID NO: 953 - protein, 8 aa, Artificial Sequence
  Description of Artificial Sequence: Synthetic peptide
QQYYNFPT

SEQ ID NO: 954 - protein, 9 aa, Artificial Sequence
  Description of Artificial Sequence: Synthetic peptide
LQHNSWPLT

SEQ ID NO: 955 - protein, 9 aa, Artificial Sequence
  Description of Artificial Sequence: Synthetic peptide
LQYDDLPYT

SEQ ID NO: 956 - protein, 9 aa, Artificial Sequence
  Description of Artificial Sequence: Synthetic peptide
LQHNSRPLT

SEQ ID NO: 957 - protein, 9 aa, Artificial Sequence
  Description of Artificial Sequence: Synthetic peptide
HQWSSNPWT

SEQ ID NO: 958 - protein, 8 aa, Artificial Sequence
  Description of Artificial Sequence: Synthetic peptide
CQYNNGNT

SEQ ID NO: 959 - protein, 8 aa, Artificial Sequence
  Description of Artificial Sequence: Synthetic peptide
QQYYNFPT

SEQ ID NO: 960 - protein, 9 aa, Artificial Sequence
  Description of Artificial Sequence: Synthetic peptide
LQYDDLPYT

SEQ ID NO: 961 - protein, 10 aa, Artificial Sequence
  Description of Artificial Sequence: Synthetic peptide
QQYYNFPPWT

SEQ ID NO: 962 - protein, 10 aa, Artificial Sequence
  Description of Artificial Sequence: Synthetic peptide
HSYDSGINIV

SEQ ID NO: 963 - protein, 9 aa, Artificial Sequence
  Description of Artificial Sequence: Synthetic peptide
LQHNSWPLT

SEQ ID NO: 964 - protein, 9 aa, Artificial Sequence
  Description of Artificial Sequence: Synthetic peptide
LQHNSRPLT

SEQ ID NO: 965 - protein, 9 aa, Artificial Sequence
  Description of Artificial Sequence: Synthetic peptide
HQWSSNPWT

SEQ ID NO: 966 - protein, 8 aa, Artificial Sequence
  Description of Artificial Sequence: Synthetic peptide
CQYNNGNT

SEQ ID NO: 967 - protein, 119 aa, Artificial Sequence
  Description of Artificial Sequence: Synthetic polypeptide
QIQLVQSGPELKKPGESVKISCKTSEYTFTDYAFHWVKQAPGKGLKWMGWINTYSGKPTYADDFKGRFVFSLEDSARTANLQISNLKNEDTATYFCARGAYYGYRDWFTYWGQGTLVTV

SEQ ID NO: 968 - protein, 115 aa, Artificial Sequence
  Description of Artificial Sequence: Synthetic polypeptide
EVQLVESGGGLVQPGRSLKLSCLASGFTFSKYGMNWIRQAPGKGLEWVASISSTSIYIYYADTVKGRFTISRENAKNTLYLQMTSLRSEDTALYYCARHDYSSYSYWGQGVMVTV

SEQ ID NO: 969 - protein, 117 aa, Artificial Sequence
  Description of Artificial Sequence: Synthetic polypeptide
EVQLVESGGGLVQPGRSLKLSCAASGFTFRDYYMAWVRQAPKKGLEWVASISYEGNPYYGDSVKGRFTISRNNAKSTLYLQMNSLRSEDTATYYCARHDHNNVDWFAYWGQGTLVTV

SEQ ID NO: 970 - protein, 122 aa, Artificial Sequence
  Description of Artificial Sequence: Synthetic polypeptide
QVTLKESGPGILQPSQTLSLTCTFTRFSLSTYGMSVGWIRQPSGKGLEWLADIWWDDDKHYNPSLKNRLTISKDTSKNQAFLKITNVDTADTATYYCARSSTTDGIVTYVMDVWGQGASVTV

SEQ ID NO: 971 - protein, 119 aa, Artificial Sequence
  Description of Artificial Sequence: Synthetic polypeptide
EVQLVESGGGLVQPGTSLKLSCVASGFTFSSSGMQWIRQAPKKGLEWISGIYYDSYKKSYADSVKGRFTISRDNSKNTLYLEMNSLRSEDTATYYCAKSAYYGYKDYFDYWGQGVMVTV

SEQ ID NO: 972 - protein, 121 aa, Artificial Sequence
  Description of Artificial Sequence: Synthetic polypeptide
QVTLKESGPGLLQPSQTLSLTCTFAGFSLNTHGMGVGWIRQPSGKGLEWLANIWWDDDKYYNPSLKNRLTMSKDTSNNQAFLKITNVDTADTATYYCARIEGSPVVTTVFDYWGQGVMVTV

SEQ ID NO: 973 - protein, 120 aa, Artificial Sequence
  Description of Artificial Sequence: Synthetic polypeptide
QVTLKESGPGMLQPSKTLSLTCSFSGFSLSTSGMVVSWIRQPSGKSLEWLAAIAWDGDKYYNPSLKSRVTVSKDTSNTQVFLRITSVDIADTATYYCTRRDYDVGYYYFDFWGQGVMVTV

SEQ ID NO: 974 - protein, 119 aa, Artificial Sequence
  Description of Artificial Sequence: Synthetic polypeptide
QIQLVQSGPELKKPGESVKISCKASGNTVTGYAMHWVRQAPGKGLKWMGWINTYSGKPTYADDFKGRCVFSLEASASTAHLQISNLKNEDTATYFCARSTYYGYKDWFAYWGQGTLVTV

SEQ ID NO: 975 - protein, 117 aa, Artificial Sequence; identical to SEQ ID NO: 969
  Description of Artificial Sequence: Synthetic polypeptide

SEQ ID NO: 976 - protein, 119 aa, Artificial Sequence; identical to SEQ ID NO: 971
  Description of Artificial Sequence: Synthetic polypeptide

SEQ ID NO: 977 - protein, 119 aa, Artificial Sequence; identical to SEQ ID NO: 967
  Description of Artificial Sequence: Synthetic polypeptide

SEQ ID NO: 978 - protein, 115 aa, Artificial Sequence; identical to SEQ ID NO: 968
  Description of Artificial Sequence: Synthetic polypeptide

SEQ ID NO: 979 - protein, 122 aa, Artificial Sequence; identical to SEQ ID NO: 970
  Description of Artificial Sequence: Synthetic polypeptide

SEQ ID NO: 980 - protein, 121 aa, Artificial Sequence; identical to SEQ ID NO: 972
  Description of Artificial Sequence: Synthetic polypeptide

SEQ ID NO: 981 - protein, 120 aa, Artificial Sequence; identical to SEQ ID NO: 973
  Description of Artificial Sequence: Synthetic polypeptide

SEQ ID NO: 982 - protein, 119 aa, Artificial Sequence; identical to SEQ ID NO: 974
  Description of Artificial Sequence: Synthetic polypeptide

SEQ ID NO: 983 - protein, 119 aa, Artificial Sequence
  Description of Artificial Sequence: Synthetic polypeptide
QVQLVQSGAEVKKPGASVKVSCKASGFTFRDYYMAWVRQAPGQGLEWMGSISYEGNPYYGDSVKGRVTMTRDNSTSTLYMELSSLRSEDTAVYYCARHDHNNVDWFAYWGQGTLVTVSS

SEQ ID NO: 984 - protein, 119 aa, Artificial Sequence
  Description of Artificial Sequence: Synthetic polypeptide
EVQLVQSGAEVKKPGESLKISCKGSGFTFRDYYMAWVRQMPGKGLEWMGSISYEGNPYYGDSVKGQVTISRDNSISTLYLQWSSLKASDTAMYYCARHDHNNVDWFAYWGQGTLVTVSS

SEQ ID NO: 985 - protein, 119 aa, Artificial Sequence
  Description of Artificial Sequence: Synthetic polypeptide
QVQLVESGGGVVQPGRSLRLSCAASGFTFRDYYMAWVRQAPGKGLEWVASISYEGNPYYGDSVKGRFTISRDNAKSTLYLQMSSLRAEDTAVYYCARHDHNNVDWFAYWGQGTLVTVSS

SEQ ID NO: 986 - protein, 119 aa, Artificial Sequence
  Description of Artificial Sequence: Synthetic polypeptide
QVQLVQSGAEVKKPGASVKVSCKASGFTFRDYYMAWVRQAPGQRLEWMGSISYEGNPYYGDSVKGRVTITRDNSASTLYMELSSLRSEDTAVYYCARHDHNNVDWFAYWGQGTLVTVSS

SEQ ID NO: 987 - protein, 114 aa, Artificial Sequence
  Description of Artificial Sequence: Synthetic polypeptide
DIVMTQTPSSQAVSAGEKVTMSCKSSQSLLYSENKKNYLAWYQQKPGQSPKLLIYWASTRESGVPDRFIGSGSGTDFTLTISSVQAEDLAVYYCQQYYNFPPWTFGGGTKLELK

SEQ ID NO: 988 - protein, 111 aa, Artificial Sequence
  Description of Artificial Sequence: Synthetic polypeptide
QVVLTQPKSVSTSLESTVKLSCKINSGNIGSYFIHWYQQHEGRSPTTMIYRDDKRPHGVPDRFSGSIDSSSNSAFLTINNVQTEDEAIYFCHSYDSGINIVFGGGTKLTVL

SEQ ID NO: 989 - protein, 112 aa, Artificial Sequence
  Description of Artificial Sequence: Synthetic polypeptide
DIVMTQTPSSQAVSAGEKVTMSCKSSQSLLYSENKKNYLAWYQQKPGQSPKLLIFWASTRESGVPDRFIGSGSGTDFTLTISSVQAEDLAVYYCQQYYNFPTFGSGTKLEIK

SEQ ID NO: 990 - protein, 107 aa, Artificial Sequence
  Description of Artificial Sequence: Synthetic polypeptide
DVQMTQSPSLLSASVGDAVTINCKASQNINRYLNWYQQKLGEGPRLLIYSANSLQTGIPSRFSGSGSGADFTLTITSPQPEDVATYFCLQHNSWPLTFGSGTKLEIK

SEQ ID NO: 991 - protein, 107 aa, Artificial Sequence
  Description of Artificial Sequence: Synthetic polypeptide
DIQMTQSPPSLSASLGDKVTITCQASQNINKYIAWYQQKPGKAPRLLIRYTSTLESGTPSRFSGSGSGRDYSFSISNVESGDVASYYCLQYDDLPYTFGPGTKLELK

SEQ ID NO: 992 - protein, 107 aa, Artificial Sequence
  Description of Artificial Sequence: Synthetic polypeptide
DIQMTQSPSFLSASVGDRVTINCKASQNINRYLNWYQQKLGEAPKLLIYNANSLQTGIPSRFSGSGSGTDFTLTISSLQPADVATYFCLQHNSRPLTFGSGTILEIK

SEQ ID NO: 993 - protein, 106 aa, Artificial Sequence
  Description of Artificial Sequence: Synthetic polypeptide
KIVLTQSPTITAASPGEKVTITCLASSRVSNIYWYQQKSGASPKLLIYSTSSLASGVPYRFSGSGSGTSYSLTINTMEAEDAATYYCHQWSSNPWTFGGGTKLELK

SEQ ID NO: 994 - protein, 106 aa, Artificial Sequence
  Description of Artificial Sequence: Synthetic polypeptide
NIQLTQSPSRLSASVGDRVTLSCKGSQNINNYLAWYQQKLGEAPKLLIYNTNNLQTGIPSRFSGSGSGTDYTFTISGLQPEDVATYFCCQYNNGNTFGAGTKLELK

SEQ ID NO: 995 - protein, 112 aa, Artificial Sequence; identical to SEQ ID NO: 989
  Description of Artificial Sequence: Synthetic polypeptide

SEQ ID NO: 996 - protein, 107 aa, Artificial Sequence; identical to SEQ ID NO: 991
  Description of Artificial Sequence: Synthetic polypeptide

SEQ ID NO: 997 - protein, 114 aa, Artificial Sequence; identical to SEQ ID NO: 987
  Description of Artificial Sequence: Synthetic polypeptide

SEQ ID NO: 998 - protein, 111 aa, Artificial Sequence; identical to SEQ ID NO: 988
  Description of Artificial Sequence: Synthetic polypeptide

SEQ ID NO: 999 - protein, 107 aa, Artificial Sequence; identical to SEQ ID NO: 990
  Description of Artificial Sequence: Synthetic polypeptide

SEQ ID NO: 1000 - protein, 107 aa, Artificial Sequence; identical to SEQ ID NO: 992
  Description of Artificial Sequence: Synthetic polypeptide

SEQ ID NO: 1001 - protein, 106 aa, Artificial Sequence; identical to SEQ ID NO: 993
  Description of Artificial Sequence: Synthetic polypeptide

SEQ ID NO: 1002 - protein, 106 aa, Artificial Sequence; identical to SEQ ID NO: 994
  Description of Artificial Sequence: Synthetic polypeptide

SEQ ID NO: 1003 - protein, 112 aa, Artificial Sequence
  Description of Artificial Sequence: Synthetic polypeptide
DIQMTQSPSSLSASVGDRVTITCKSSQSLLYSENKKNYLAWYQQKPGKVPKLLIFWASTRESGVPSRFSGSGSGTDFTLTISSLQPEDVATYYCQQYYNFPTFGQGTKLEIK

SEQ ID NO: 1004 - protein, 112 aa, Artificial Sequence
  Description of Artificial Sequence: Synthetic polypeptide
EIVMTQSPATLSLSPGERATLSCKSSQSLLYSENKKNYLAWYQQKPGQAPRLLIFWASTRESGIPARFSGSGSGTDFTLTISSLQPEDLAVYYCQQYYNFPTFGQGTKLEIK

SEQ ID NO: 1005 - protein, 112 aa, Artificial Sequence
  Description of Artificial Sequence: Synthetic polypeptide
DIVMTQTPLSLSVTPGQPVSMSCKSSQSLLYSENKKNYLAWYLQKPGQSPQLLIFWASTRESGVPDRFSGSGSGTDFTLKISRVEAEDVGVYYCQQYYNFPTFGQGTKLEIK

SEQ ID NO: 1006 - protein, 10 aa, Artificial Sequence
  Description of Artificial Sequence: Synthetic peptide
GYTFTDYYMH

SEQ ID NO: 1007 - protein, 10 aa, Artificial Sequence
  Description of Artificial Sequence: Synthetic peptide
GYTFTGYYMH

SEQ ID NO: 1008 - protein, 10 aa, Artificial Sequence
  Description of Artificial Sequence: Synthetic peptide
GYTFTGYYMH

SEQ ID NO: 1009 - protein, 10 aa, Artificial Sequence
  Description of Artificial Sequence: Synthetic peptide
GYIFTGYYIH

SEQ ID NO: 1010 - protein, 17 aa, Artificial Sequence
  Description of Artificial Sequence: Synthetic peptide
WINPNSGDTNYAQKFQG

SEQ ID NO: 1011 - protein, 17 aa, Artificial Sequence
  Description of Artificial Sequence: Synthetic peptide
WINPNSGGTNYAQKFQG

SEQ ID NO: 1012 - protein, 17 aa, Artificial Sequence
  Description of Artificial Sequence: Synthetic peptide
WINPNSGGTNYAQKFQG

SEQ ID NO: 1013 - protein, 17 aa, Artificial Sequence
  Description of Artificial Sequence: Synthetic peptide
WINPNSGGTNYAQKFQG

SEQ ID NO: 1014 - protein, 12 aa, Artificial Sequence
  Description of Artificial Sequence: Synthetic peptide
DMNILATVPFDI

SEQ ID NO: 1015 - protein, 12 aa, Artificial Sequence
  Description of Artificial Sequence: Synthetic peptide
DMNILATVPFDI

SEQ ID NO: 1016 - protein, 12 aa, Artificial Sequence
  Description of Artificial Sequence: Synthetic peptide
DMNILATVPFDI

SEQ ID NO: 1017 - protein, 12 aa, Artificial Sequence
  Description of Artificial Sequence: Synthetic peptide
DMNILATVPFDI

SEQ ID NO: 1018 - protein, 11 aa, Artificial Sequence
  Description of Artificial Sequence: Synthetic peptide
RASQSISSYLN

SEQ ID NO: 1019 - protein, 11 aa, Artificial Sequence
  Description of Artificial Sequence: Synthetic peptide
RASQSISTYLN

SEQ ID NO: 1020 - protein, 11 aa, Artificial Sequence
  Description of Artificial Sequence: Synthetic peptide
RASQSISSYLN

SEQ ID NO: 1021 - protein, 11 aa, Artificial Sequence
  Description of Artificial Sequence: Synthetic peptide
RASQSISSYLN

SEQ ID NO: 1022 - protein, 7 aa, Artificial Sequence
  Description of Artificial Sequence: Synthetic peptide
AASSLQS

SEQ ID NO: 1023 - protein, 7 aa, Artificial Sequence
  Description of Artificial Sequence: Synthetic peptide
AAFSLQS

SEQ ID NO: 1024 - protein, 7 aa, Artificial Sequence
  Description of Artificial Sequence: Synthetic peptide
AASSLQS

SEQ ID NO: 1025 - protein, 7 aa, Artificial Sequence
  Description of Artificial Sequence: Synthetic peptide
AASSLQS

SEQ ID NO: 1026 - protein, 9 aa, Artificial Sequence
  Description of Artificial Sequence: Synthetic peptide
QQGDSVPLT

SEQ ID NO: 1027 - protein, 9 aa, Artificial Sequence
  Description of Artificial Sequence: Synthetic peptide
QQGDSVPLT

SEQ ID NO: 1028 - protein, 9 aa, Artificial Sequence
  Description of Artificial Sequence: Synthetic peptide
QQGDSVPLT

SEQ ID NO: 1029 - protein, 9 aa, Artificial Sequence
  Description of Artificial Sequence: Synthetic peptide
QQGDSVPLT

SEQ ID NO: 1030 - protein, 10 aa, Artificial Sequence
  Description of Artificial Sequence: Synthetic peptide
GYTFTDYYMH

SEQ ID NO: 1031 - protein, 10 aa, Artificial Sequence
  Description of Artificial Sequence: Synthetic peptide
GYTFTGYYMH

SEQ ID NO: 1032 - protein, 10 aa, Artificial Sequence
  Description of Artificial Sequence: Synthetic peptide
GYIFTGYYIH

SEQ ID NO: 1033 - protein, 10 aa, Artificial Sequence
  Description of Artificial Sequence: Synthetic peptide
GYTFTGYYMH

SEQ ID NO: 1034 - protein, 17 aa, Artificial Sequence
  Description of Artificial Sequence: Synthetic peptide
WINPNSGDTNYAQKFQG

SEQ ID NO: 1035 - protein, 17 aa, Artificial Sequence
  Description of Artificial Sequence: Synthetic peptide
WINPNSGGTNYAQKFQG

SEQ ID NO: 1036 - protein, 17 aa, Artificial Sequence
  Description of Artificial Sequence: Synthetic peptide
WINPNSGGTNYAQKFQG

SEQ ID NO: 1037 - protein, 17 aa, Artificial Sequence
  Description of Artificial Sequence: Synthetic peptide
WINPNSGGTNYAQKFQG

SEQ ID NO: 1038 - protein, 12 aa, Artificial Sequence
  Description of Artificial Sequence: Synthetic peptide
DMNILATVPFDI

SEQ ID NO: 1039 - protein, 12 aa, Artificial Sequence
  Description of Artificial Sequence: Synthetic peptide
DMNILATVPFDI

SEQ ID NO: 1040 - protein, 12 aa, Artificial Sequence
  Description of Artificial Sequence: Synthetic peptide
DMNILATVPFDI

SEQ ID NO: 1041 - protein, 12 aa, Artificial Sequence
  Description of Artificial Sequence: Synthetic peptide
DMNILATVPFDI

SEQ ID NO: 1042 - protein, 11 aa, Artificial Sequence
  Description of Artificial Sequence: Synthetic peptide
RASQSISTYLN

SEQ ID NO: 1043 - protein, 11 aa, Artificial Sequence
  Description of Artificial Sequence: Synthetic peptide
RASQSISSYLN

SEQ ID NO: 1044 - protein, 11 aa, Artificial Sequence
  Description of Artificial Sequence: Synthetic peptide
RASQSISSYLN

SEQ ID NO: 1045 - protein, 11 aa, Artificial Sequence
  Description of Artificial Sequence: Synthetic peptide
RASQSISSYLN

SEQ ID NO: 1046 - protein, 7 aa, Artificial Sequence
  Description of Artificial Sequence: Synthetic peptide
AASSLQS

SEQ ID NO: 1047 - protein, 7 aa, Artificial Sequence
  Description of Artificial Sequence: Synthetic peptide
AAFSLQS

SEQ ID NO: 1048 - protein, 7 aa, Artificial Sequence
  Description of Artificial Sequence: Synthetic peptide
AASSLQS

SEQ ID NO: 1049 - protein, 7 aa, Artificial Sequence
  Description of Artificial Sequence: Synthetic peptide
AASSLQS

SEQ ID NO: 1050 - protein, 9 aa, Artificial Sequence
  Description of Artificial Sequence: Synthetic peptide
QQGDSVPLT

SEQ ID NO: 1051 - protein, 9 aa, Artificial Sequence
  Description of Artificial Sequence: Synthetic peptide
QQGDSVPLT

SEQ ID NO: 1052 - protein, 9 aa, Artificial Sequence
  Description of Artificial Sequence: Synthetic peptide
QQGDSVPLT

SEQ ID NO: 1053 - protein, 9 aa, Artificial Sequence
  Description of Artificial Sequence: Synthetic peptide
QQGDSVPLT

SEQ ID NO: 1054 - protein, 5 aa, Artificial Sequence
  Description of Artificial Sequence: Synthetic peptide
GYYMH

SEQ ID NO: 1055 - protein, 5 aa, Artificial Sequence
  Description of Artificial Sequence: Synthetic peptide
GYYMH

SEQ ID NO: 1056 - protein, 5 aa, Artificial Sequence
  Description of Artificial Sequence: Synthetic peptide
GYYIH

SEQ ID NO: 1057 - protein, 5 aa, Artificial Sequence
  Description of Artificial Sequence: Synthetic peptide
DYYMH

SEQ ID NO: 1058 - protein, 17 aa, Artificial Sequence
  Description of Artificial Sequence: Synthetic peptide
WINPNSGGTNYAQKFQG

SEQ ID NO: 1059 - protein, 17 aa, Artificial Sequence
  Description of Artificial Sequence: Synthetic peptide
WINPNSGGTNYAQKFQG

SEQ ID NO: 1060 - protein, 17 aa, Artificial Sequence
  Description of Artificial Sequence: Synthetic peptide
WINPNSGGTNYAQKFQG

SEQ ID NO: 1061 - protein, 17 aa, Artificial Sequence
  Description of Artificial Sequence: Synthetic peptide
WINPNSGDTNYAQKFQG

SEQ ID NO: 1062 - protein, 12 aa, Artificial Sequence
  Description of Artificial Sequence: Synthetic peptide
DMNILATVPFDI

SEQ ID NO: 1063 - protein, 12 aa, Artificial Sequence
  Description of Artificial Sequence: Synthetic peptide
DMNILATVPFDI

SEQ ID NO: 1064 - protein, 12 aa, Artificial Sequence
  Description of Artificial Sequence: Synthetic peptide
DMNILATVPFDI

SEQ ID NO: 1065 - protein, 12 aa, Artificial Sequence
  Description of Artificial Sequence: Synthetic peptide
DMNILATVPFDI

SEQ ID NO: 1066 - protein, 11 aa, Artificial Sequence
  Description of Artificial Sequence: Synthetic peptide
RASQSISTYLN

SEQ ID NO: 1067 - protein, 11 aa, Artificial Sequence
  Description of Artificial Sequence: Synthetic peptide
RASQSISSYLN

SEQ ID NO: 1068 - protein, 11 aa, Artificial Sequence
  Description of Artificial Sequence: Synthetic peptide
RASQSISSYLN

SEQ ID NO: 1069 - protein, 11 aa, Artificial Sequence
  Description of Artificial Sequence: Synthetic peptide
RASQSISSYLN

SEQ ID NO: 1070 - protein, 7 aa, Artificial Sequence
  Description of Artificial Sequence: Synthetic peptide
AAFSLQS

SEQ ID NO: 1071 - protein, 7 aa, Artificial Sequence
  Description of Artificial Sequence: Synthetic peptide
AASSLQS

SEQ ID NO: 1072 - protein, 7 aa, Artificial Sequence
  Description of Artificial Sequence: Synthetic peptide
AASSLQS

SEQ ID NO: 1073 - protein, 7 aa, Artificial Sequence
  Description of Artificial Sequence: Synthetic peptide
AASSLQS

SEQ ID NO: 1074 - protein, 9 aa, Artificial Sequence
  Description of Artificial Sequence: Synthetic peptide
QQGDSVPLT

SEQ ID NO: 1075 - protein, 9 aa, Artificial Sequence
  Description of Artificial Sequence: Synthetic peptide
QQGDSVPLT

SEQ ID NO: 1076 - protein, 9 aa, Artificial Sequence
  Description of Artificial Sequence: Synthetic peptide
QQGDSVPLT

SEQ ID NO: 1077 - protein, 9 aa, Artificial Sequence
  Description of Artificial Sequence: Synthetic peptide
QQGDSVPLT

SEQ ID NO: 1078 - protein, 7 aa, Artificial Sequence
  Description of Artificial Sequence: Synthetic peptide
GYTFTGY

SEQ ID NO: 1079 - protein, 7 aa, Artificial Sequence
  Description of Artificial Sequence: Synthetic peptide
GYTFTGY

SEQ ID NO: 1080 - protein, 7 aa, Artificial Sequence
  Description of Artificial Sequence: Synthetic peptide
GYIFTGY

SEQ ID NO: 1081 - protein, 7 aa, Artificial Sequence
  Description of Artificial Sequence: Synthetic peptide
GYTFTDY

SEQ ID NO: 1082 - protein, 6 aa, Artificial Sequence
  Description of Artificial Sequence: Synthetic peptide
NPNSGG

SEQ ID NO: 1083 - protein, 6 aa, Artificial Sequence
  Description of Artificial Sequence: Synthetic peptide
NPNSGG

SEQ ID NO: 1084 - protein, 6 aa, Artificial Sequence
  Description of Artificial Sequence: Synthetic peptide
NPNSGG

SEQ ID NO: 1085 - protein, 6 aa, Artificial Sequence
  Description of Artificial Sequence: Synthetic peptide
NPNSGD

SEQ ID NO: 1086 - protein, 12 aa, Artificial Sequence
  Description of Artificial Sequence: Synthetic peptide
DMNILATVPFDI

SEQ ID NO: 1087 - protein, 12 aa, Artificial Sequence
  Description of Artificial Sequence: Synthetic peptide
DMNILATVPFDI

SEQ ID NO: 1088 - protein, 12 aa, Artificial Sequence
  Description of Artificial Sequence: Synthetic peptide
DMNILATVPFDI

SEQ ID NO: 1089 - protein, 12 aa, Artificial Sequence
  Description of Artificial Sequence: Synthetic peptide
DMNILATVPFDI

SEQ ID NO: 1090 - protein, 7 aa, Artificial Sequence
  Description of Artificial Sequence: Synthetic peptide
SQSISTY

SEQ ID NO: 1091 - protein, 7 aa, Artificial Sequence
  Description of Artificial Sequence: Synthetic peptide
SQSISSY

SEQ ID NO: 1092 - protein, 7 aa, Artificial Sequence
  Description of Artificial Sequence: Synthetic peptide
SQSISSY

SEQ ID NO: 1093 - protein, 7 aa, Artificial Sequence
  Description of Artificial Sequence: Synthetic peptide
SQSISSY

SEQ ID NO: 1094 - protein, 3 aa, Artificial Sequence
  Description of Artificial Sequence: Synthetic peptide
AAF

SEQ ID NO: 1095 - protein, 3 aa, Artificial Sequence
  Description of Artificial Sequence: Synthetic peptide
AAS

SEQ ID NO: 1096 - protein, 3 aa, Artificial Sequence
  Description of Artificial Sequence: Synthetic peptide
AAS

SEQ ID NO: 1097 - protein, 3 aa, Artificial Sequence
  Description of Artificial Sequence: Synthetic peptide
AAS

SEQ ID NO: 1098 - protein, 6 aa, Artificial Sequence
  Description of Artificial Sequence: Synthetic peptide
GDSVPL

SEQ ID NO: 1099 - protein, 6 aa, Artificial Sequence
  Description of Artificial Sequence: Synthetic peptide
GDSVPL

SEQ ID NO: 1100 - protein, 6 aa, Artificial Sequence
  Description of Artificial Sequence: Synthetic peptide
GDSVPL

SEQ ID NO: 1101 - protein, 6 aa, Artificial Sequence
  Description of Artificial Sequence: Synthetic peptide
GDSVPL

SEQ ID NO: 1102 - protein, 10 aa, Artificial Sequence
  Description of Artificial Sequence: Synthetic peptide
GYTFTSYWMN

SEQ ID NO: 1103 - protein, 17 aa, Artificial Sequence
  Description of Artificial Sequence: Synthetic peptide
RIDPYDSETHYNQKFKD

SEQ ID NO: 1104 - protein, 6 aa, Artificial Sequence
  Description of Artificial Sequence: Synthetic peptide
GNWDDY

SEQ ID NO: 1105 - protein, 11 aa, Artificial Sequence
  Description of Artificial Sequence: Synthetic peptide
RASKSISKDLA

SEQ ID NO: 1106 - protein, 7 aa, Artificial Sequence
  Description of Artificial Sequence: Synthetic peptide
SGSTLQS

SEQ ID NO: 1107 - protein, 9 aa, Artificial Sequence
  Description of Artificial Sequence: Synthetic peptide
QQHNKYPYT

SEQ ID NO: 1108 - DNA, 762 bp, Homo sapiens
gaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtatagtgattatgcagtatctgtgaaaagtcgaataaccatcaacccagacacatccaagaaccagttctccctgcagctgaactctgtgactcccgaggacacggctgtgtattactgtgcaagagatccttacgatttttggagtggttatcctgatgcttttgatatctggggccaagggacaatggtcaccgtctcttcaggtggtggtggcagcggcggcggcggctctggtggtggtggatcccagtctgccctgactcagcctgcctccgtgtctgggtctcctggacagtcgatcaccatctcctgcactggaaccagcagtgacgttggtggttacaactatgtctcctggtaccaacagcacccaggcaaagcccccaaggtcataatttctgaggtcaataatcggccctcaggggtttctcatcgcttctctgggtccaagtctggcaacacggcctccctgaccatctctgggctccaggctgaggacgaggctgattatttctgcagctcatatacaagtggcaggactctttatgtcttcggaactgggagcaaggtcaccgtcctaggt

SEQ ID NO: 1109 - protein, 498 aa, Homo sapiens
MALPVTALLLPLALLLHAARPEVQLQQSGPGLVKPSQTLSLTCAISGDSVSSNSAAWNWIRQSPSRGLEWLGRTYYRSKWYSDYAVSVKSRITINPDTSKNQFSLQLNSVTPEDTAVYYCARDPYDFWSGYPDAFDIWGQGTMVTVSSGGGGSGGGGSGGGGSQSALTQPASVSGSPGQSITISCTGTSSDVGGYNYVSWYQQHPGKAPKVIISEVNNRPSGVSHRFSGSKSGNTASLTISGLQAEDEADYFCSSYTSGRTLYVFGTGSKVTVLGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1110 - DNA, 1494 bp, Homo sapiens
atggccctccctgtcaccgccctgctgcttccgctggctcttctgctccacgccgctcggcccgaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtatagtgattatgcagtatctgtgaaaagtcgaataaccatcaacccagacacatccaagaaccagttctccctgcagctgaactctgtgactcccgaggacacggctgtgtattactgtgcaagagatccttacgatttttggagtggttatcctgatgcttttgatatctggggccaagggacaatggtcaccgtctcttcaggtggtggtggcagcggcggcggcggctctggtggtggtggatcccagtctgccctgactcagcctgcctccgtgtctgggtctcctggacagtcgatcaccatctcctgcactggaaccagcagtgacgttggtggttacaactatgtctcctggtaccaacagcacccaggcaaagcccccaaggtcataatttctgaggtcaataatcggccctcaggggtttctcatcgcttctctgggtccaagtctggcaacacggcctccctgaccatctctgggctccaggctgaggacgaggctgattatttctgcagctcatatacaagtggcaggactctttatgtcttcggaactgggagcaaggtcaccgtcctaggtaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1111 - protein, 12 aa, Artificial Sequence
  Description of Artificial Sequence: Synthetic peptide
GDSVSSNSAAWN

SEQ ID NO: 1112 - protein, 10 aa, Artificial Sequence
  Description of Artificial Sequence: Synthetic peptide
GDSVSSNSAA

SEQ ID NO: 1113 - protein, 18 aa, Artificial Sequence
  Description of Artificial Sequence: Synthetic peptide
RTYYRSKWYSDYAVSVKS

SEQ ID NO: 1114 - protein, 9 aa, Artificial Sequence
  Description of Artificial Sequence: Synthetic peptide
TYYRSKWYS

SEQ ID NO: 1115 - protein, 15 aa, Artificial Sequence
  Description of Artificial Sequence: Synthetic peptide
DPYDFWSGYPDAFDI

SEQ ID NO: 1116 - protein, 17 aa, Artificial Sequence
  Description of Artificial Sequence: Synthetic peptide
ARDPYDFWSGYPDAFDI

SEQ ID NO: 1117 - protein, 14 aa, Artificial Sequence
  Description of Artificial Sequence: Synthetic peptide
TGTSSDVGGYNYVS

SEQ ID NO: 1118 - protein, 9 aa, Artificial Sequence
  Description of Artificial Sequence: Synthetic peptide
SSDVGGYNY

SEQ ID NO: 1119 - protein, 7 aa, Artificial Sequence
  Description of Artificial Sequence: Synthetic peptide
EVNNRPS

SEQ ID NO: 1120 - protein, 3 aa, Artificial Sequence
  Description of Artificial Sequence: Synthetic peptide
EVN

SEQ ID NO: 1121 - protein, 11 aa, Artificial Sequence
  Description of Artificial Sequence: Synthetic peptide
SSYTSGRTLYV

SEQ ID NO: 1122 - protein, 11 aa, Artificial Sequence
  Description of Artificial Sequence: Synthetic peptide
SSYTSGRTLYV

SEQ ID NO: 1123 - DNA, 1461 bp, Artificial Sequence
  Description of Artificial Sequence: Synthetic polynucleotide
atggccctccctgtcaccgccctgctgcttccgctggctcttctgctccacgccgctcggccccaagtccaactcgtccagtcaggagcggaagtcaagaagcccggagcgtcagtcaaagtgtcatgcaaagcctcgggctacactttcactgggtactacatgcactgggtgcgccaggctccaggacagggactggaatggatgggatggatcaacccgaactccggtggcaccaattacgcccagaagttccaggggagggtgaccatgactcgcgacacgtcgatcagcaccgcatacatggagctgtcaagactccggtccgacgatactgccgtgtactactgcgcacgggacatgaacattctggccaccgtgccttttgacatctggggtcagggaactatggttaccgtgtcctctggtggaggcggctccggcggggggggaagcggaggcggtggaagcgacattcagatgacccagtcgccttcatccctttcggcgagcgtgggagatcgcgtcactatcacttgtcgggcctcgcagtccatctccacctacctcaattggtaccagcagaagccaggaaaagcaccgaatctgctgatctacgccgcgttttccttgcaatcgggagtgccaagcagattcagcggatcgggatcaggcactgatttcaccctcaccatcaactcgctgcaaccggaggatttcgctacgtactattgccaacaaggagacagcgtgccgctcaccttcggcggagggactaagctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1124 - protein, 487 aa, Artificial Sequence
  Description of Artificial Sequence: Synthetic polypeptide
MALPVTALLLPLALLLHAARPQVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDMNILATVPFDIWGQGTMVTVSSGGGGSGGGGSGGGGSDIQMTQSPSSLSASVGDRVTITCRASQSISTYLNWYQQKPGKAPNLLIYAAFSLQSGVPSRFSGSGSGTDFTLTINSLQPEDFATYYCQQGDSVPLTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1125 - protein, 264 aa, Artificial Sequence
  Description of Artificial Sequence: Synthetic polypeptide
MALPVTALLLPLALLLHAARPQVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDMNILATVPFDIWGQGTMVTVSSGGGGSGGGGSGGGGSDIQMTQSPSSLSASVGDRVTITCRASQSISTYLNWYQQKPGKAPNLLIYAAFSLQSGVPSRFSGSGSGTDFTLTINSLQPEDFATYYCQQGDSVPLTFGGGTKLEIK

SEQ ID NO: 1126 - protein, 121 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDMNILATVPFDIWGQGTMVTVSS

SEQ ID NO: 1127 - protein, 107 aa, Artificial Sequence
  Description of Artificial Sequence: Synthetic polypeptide
DIQMTQSPSSLSASVGDRVTITCRASQSISTYLNWYQQKPGKAPNLLIYAAFSLQSGVPSRFSGSGSGTDFTLTINSLQPEDFATYYCQQGDSVPLTFGGGTKLEIK

SEQ ID NO: 1128 - DNA, 1461 bp, Artificial Sequence
  Description of Artificial Sequence: Synthetic polynucleotide
atggccctccctgtcaccgccctgctgcttccgctggctcttctgctccacgccgctcggccccaagtgcaactcgtccaaagcggagcggaagtcaagaaacccggagcgagcgtgaaagtgtcctgcaaagcctccggctacacctttacgggctactacatgcactgggtgcgccaggcaccaggacagggtcttgaatggatgggatggatcaaccctaattcgggcggaactaactacgcacagaagttccaggggagagtgactctgactcgggatacctccatctcaactgtctacatggaactctcccgcttgcggtcagatgatacggcagtgtactactgcgcccgcgacatgaatatcctggctaccgtgccgttcgacatctggggacaggggactatggttactgtctcatcgggcggtggaggttcaggaggaggcggctcgggaggcggaggttcggacattcagatgacccagtccccatcctctctgtcggccagcgtcggagatagggtgaccattacctgtcgggcctcgcaaagcatctcctcgtacctcaactggtatcagcaaaagccgggaaaggcgcctaagctgctgatctacgccgcttcgagcttgcaaagcggggtgccatccagattctcgggatcaggctcaggaaccgacttcaccctgaccgtgaacagcctccagccggaggactttgccacttactactgccagcagggagactccgtgccgcttactttcggggggggtacccgcctggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1129 - protein, 487 aa, Artificial Sequence
  Description of Artificial Sequence: Synthetic polypeptide
MALPVTALLLPLALLLHAARPQVQLVQSGAEVKKPGASVKVSCKASGYTFTGYYMHWVRQAPGQGLEWMGWINPNSGGTNYAQKFQGRVTLTRDTSISTVYMELSRLRSDDTAVYYCARDMNILATVPFDIWGQGTMVTVSSGGGGSGGGGSGGGGSDIQMTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1130 - protein, 264 aa, Artificial Sequence
  Description of Artificial Sequence: Synthetic polypeptide
MALPVTALLLPLALLLHAARPQVQLVQSGAEVKKPGASVKVSCKASGYTFTGYYMHWVRQAPGQGLEWMGWINPNSGGTNYAQKFQGRVTLTRDTSISTVYMELSRLRSDDTAVYYCARDMNILATVPFDIWGQGTMVTVSSGGGGSGGGGSGGGGSDIQMTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTRLEIK

SEQ ID NO: 1131 - protein, 121 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTLTRDTSISTVYMELSRLRSDDTAVYYCARDMNILATVPFDIWGQGTMVTVSS

SEQ ID NO: 1132 - protein, 107 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTRLEIK

SEQ ID NO: 1133 - DNA, 1461 bp, Artificial Sequence
  Description of Artificial Sequence: Synthetic polynucleotide
atggccctccctgtcaccgccctgctgcttccgctggctcttctgctccacgccgctcggccccaagtccaactcgttcaatccggcgcagaagtcaagaagccaggagcatcagtgaaagtgtcctgcaaagcctcaggctacatcttcacgggatactacatccactgggtgcgccaggctccgggccagggccttgagtggatgggctggatcaaccctaactctgggggaaccaactacgctcagaagttccaggggagggtcactatgactcgcgatacctccatctccactgcgtacatggaactctcgggactgagatccgacgatcctgccgtgtactactgcgcccgggacatgaacatcttggcgaccgtgccgtttgacatttggggacagggcaccctcgtcactgtgtcgagcggtggaggaggctcggggggtggcggatcaggagggggaggaagcgacatccagctgactcagagcccatcgtcgttgtccgcgtcggtgggggatagagtgaccattacttgccgcgccagccagagcatctcatcatatctgaattggtaccagcagaagcccggaaaggccccaaaactgctgatctacgctgcaagcagcctccaatcgggagtgccgtcacggttctccgggtccggttcgggaactgactttaccctgaccgtgaattcgctgcaaccggaggatttcgccacgtactactgtcagcaaggagactccgtgccgctgaccttcggtggaggcaccaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1134 - protein, 487 aa, Artificial Sequence
  Description of Artificial Sequence: Synthetic polypeptide
MALPVTALLLPLALLLHAARPQVQLVQSGAEVKKPGASVKVSCKASGYIFTGYYIHWVRQAPGQGLEWMGWINPNSGGTNYAQKFQGRVTMTRDTSISTAYMELSGLRSDDPAVYYCARDMNILATVPFDIWGQGTLVTVSSGGGGSGGGGSGGGGSDIQLTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1135 - protein, 264 aa, Artificial Sequence
  Description of Artificial Sequence: Synthetic polypeptide
MALPVTALLLPLALLLHAARPQVQLVQSGAEVKKPGASVKVSCKASGYIFTGYYIHWVRQAPGQGLEWMGWINPNSGGTNYAQKFQGRVTMTRDTSISTAYMELSGLRSDDPAVYYCARDMNILATVPFDIWGQGTLVTVSSGGGGSGGGGSGGGGSDIQLTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTKVEIK

SEQ ID NO: 1136 - protein, 121 aa, Artificial Sequence
  Description of Artificial Sequence: Synthetic polypeptide
QVQLVQSGAEVKKPGASVKVSCKASGYIFTGYYIHWVRQAPGQGLEWMGWINPNSGGTNYAQKFQGRVTMTRDTSISTAYMELSGLRSDDPAVYYCARDMNILATVPFDIWGQGTLVTVSS

SEQ ID NO: 1137 - protein, 107 aa, Artificial Sequence
  Description of Artificial Sequence: Synthetic polypeptide
DIQLTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTKVEIK

SEQ ID NO: 1138 - DNA, 1467 bp, Artificial Sequence
  Description of Artificial Sequence: Synthetic polynucleotide
atggccctccctgtcaccgccctgctgcttccgctggctcttctgctccacgccgctcggccccaagtccaactccaacagtcaggcgcagaagtgaaaaagagcggtgcatcggtgaaagtgtcatgcaaagcctcgggctacaccttcactgactactatatgcactggctgcggcaggcaccgggacagggacttgagtggatgggatggatcaacccgaattcaggggacactaactacgcgcagaagttccaggggagagtgaccctgacgagggacacctcaatttcgaccgtctacatggaattgtcgcgcctgagatcggacgatactgctgtgtactactgtgcccgcgacatgaacatcctcgcgactgtgccttttgatatctggggacaggggactatggtcaccgtttcctccgcttccggtggcggaggctcgggaggccgggcctccggtggaggaggcagcgacatccagatgactcagagcccttcctcgctgagcgcctcagtgggagatcgcgtgaccatcacttgccgggccagccagtccatttcgtcctacctcaattggtaccagcagaagccgggaaaggcgcccaagctcttgatctacgctgcgagctccctgcaaagcggggtgccgagccgattctcgggttccggctcgggaaccgacttcactctgaccatctcatccctgcaaccagaggactttgccacctactactgccaacaaggagattctgtcccactgacgttcggcggaggaaccaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1139 - protein, 336 aa, Artificial Sequence
  Description of Artificial Sequence: Synthetic polypeptide
MALPVTALLLPLALLLHAARPQVQLQQSGAEVKKSGASVKVSCKASGYTFTDYYMHWLRQAPGQGLEWMGWINPNSGDTNYAQKFQGRVTLTRDTSISTVYMELSRLRSDDTAVYYCARDMNILATVPFDIWGQGTMVTVSSASGGGGSGGRASGGGGSDIQMTQSPSSLSASVGDRVTITCRASQSISSYLNWYQQKPGKAPKLLIYAASSLQSGVPSRFSGSGSGTDFTLTISSLQPEDFATYYCQQGDSVPLTFGGGTKVEIKTTTPAPRPPTPAPTIASQPLSLRPEACRPAAGGAVHTRGLDFACDIYIWAPLAGTCGVLLLSLVITLYCK

SEQ ID NO: 1140 - protein, 266 aa, Artificial Sequence
  Description of Artificial Sequence: Synthetic polypeptide
MALPVTALLLPLALLLHAARPQVQLQQSGAEVKKSGASVKVSCKASGYTFTDYYMHWLRQAPGQGLEWMGWINPNSGDTNYAQKFQGRVTLTRDTSISTVYMELSRLRSDDTAVYYCARDMNILATVPFDIWGQGTMVTVSSASGGGGSGGRASGGGGSDIQMTQSPSSLSASVGDRVTITCRASQSISSYLNWYQQKPGKAPKLLIYAASSLQSGVPSRFSGSGSGTDFTLTISSLQPEDFATYYCQQGDSVPLTFGGGTKVEIK

SEQ ID NO: 1141 - protein, 121 aa, Artificial Sequence
  Description of Artificial Sequence: Synthetic polypeptide
QVQLQQSGAEVKKSGASVKVSCKASGYTFTDYYMHWLRQAPGQGLEWMGWINPNSGDTNYAQKFQGRVTLTRDTSISTVYMELSRLRSDDTAVYYCARDMNILATVPFDIWGQGTMVTVSS

SEQ ID NO: 1142 - protein, 107 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQGDSVPLTFGGGTKVEIK

SEQ ID NO: 1143 - DNA, 1458 bp, Artificial Sequence
  Description of Artificial Sequence: Synthetic polynucleotide
atggccctccctgtcaccgccctgctgcttccgctggctcttctgctccacgccgctcggccccaagtgcagctggtccagtcgggagccgaagtcaagaagcccggcgctagcgtgaaagtgtcctgcaaagcctccgggtacacattcacctcctactggatgaattgggtcagacaggcgcccggccagggactcgagtggatgggaaggattgatccttacgactccgaaacccattacaaccagaagttcaaggaccgcgtgaccatgactgtggataagtccacttccaccgcttacatggagctgtccagcctgcgctccgaggataccgcagtgtactactgcgcccggggaaactgggacgactattggggacagggaactaccgtgaccgtgtcaagcgggggtggcggtagcggaggagggggctccggcggcggcggctcagggggcggaggaagcgacgtgcagctcacccagtcgccctcatttctgtcggcctcagtgggagacagagtgaccattacttgtcgggcctccaagagcatctccaaggacctggcctggtatcagcagaagccaggaaaggcgcctaagttgctcatctactcggggtcgaccctgcaatctggcgtgccgtcccggttctccggttcgggaagcggtaccgaattcacccttactatctcctccctgcaaccggaggacttcgccacctactactgccaacagcacaacaagtacccgtacactttcgggggtggcacgaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1144 - protein, 486 aa, Artificial Sequence
  Description of Artificial Sequence: Synthetic polypeptide
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1145 - protein, 263 aa, Artificial Sequence
  Description of Artificial Sequence: Synthetic polypeptide
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIK

SEQ ID NO: 1146 - protein, 115 aa, Artificial Sequence
  Description of Artificial Sequence: Synthetic polypeptide
QVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSS

SEQ ID NO: 1147 - protein, 107 aa, Artificial Sequence
  Description of Artificial Sequence: Synthetic polypeptide
DVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIK

SEQ ID NO: 1148 - DNA, 1458 bp, Artificial Sequence
  Description of Artificial Sequence: Synthetic polynucleotide
atggccctccctgtcaccgccctgctgcttccgctggctcttctgctccacgccgctcggccccaagtgcagctggtccagtcgggagccgaagtcaagaagcccggcgctagcgtgaaagtgtcctgcaaagcctccgggtacacattcacctcctactggatgaattgggtcagacaggcgcccggccagggactcgagtggatgggaaggattgatccttacgactccgaaacccattacaaccagaagttcaaggaccgcgtgaccatgactgtggataagtccacttccaccgcttacatggagctgtccagcctgcgctccgaggataccgcagtgtactactgcgcccggggaaactgggacgactattggggacagggaactaccgtgaccgtgtcaagcgggggtggcggtagcggaggagggggctccggcggcggcggctcagggggcggaggaagcgaagtggtgctgacccagtcgcccgcaaccctctctctgtcgccgggagaacgcgccactctttcctgtcgggcgtccaagagcatctcaaaggacctcgcctggtaccagcagaagcctggtcaagccccgcggctgctgatctactccggctccacgctgcaatcaggaatcccagccagattttccggttcggggtcggggactgacttcaccttgaccattagctcgctggaacctgaggacttcgccgtgtattactgccagcagcacaacaagtacccgtacaccttcggaggcggtactaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1149 - protein, 486 aa, Artificial Sequence
  Description of Artificial Sequence: Synthetic polypeptide
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1150 - protein, 263 aa, Artificial Sequence
  Description of Artificial Sequence: Synthetic polypeptide
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIK

SEQ ID NO: 1151 - protein, 115 aa, Artificial Sequence; identical to SEQ ID NO: 1146
  Description of Artificial Sequence: Synthetic polypeptide

SEQ ID NO: 1152 - protein, 107 aa, Artificial Sequence
  Description of Artificial Sequence: Synthetic polypeptide
EVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIK

SEQ ID NO: 1153 - DNA, 1458 bp, Artificial Sequence
  Description of Artificial Sequence: Synthetic polynucleotide
atggccctccctgtcaccgccctgctgcttccgctggctcttctgctccacgccgctcggccccaagtgcagctggtccagtcgggagccgaagtcaagaagcccggcgctagcgtgaaagtgtcctgcaaagcctccgggtacacattcacctcctactggatgaattgggtcagacaggcgcccggccagggactcgagtggatgggaaggattgatccttacgactccgaaacccattacaaccagaagttcaaggaccgcgtgaccatgactgtggataagtccacttccaccgcttacatggagctgtccagcctgcgctccgaggataccgcagtgtactactgcgcccggggaaactgggacgactattggggacagggaactaccgtgaccgtgtcaagcgggggtggcggtagcggaggagggggctccggcggcggcggctcagggggcggaggaagcgacgtcgtgatgacccagtcaccggcattcctgtccgtgactcccggagaaaaggtcacgattacttgccgggcgtccaagagcatctccaaggacctcgcctggtaccaacagaagccggaccaggcccctaagctgttgatctactcggggtccacccttcaatcgggagtgccatcgcggtttagcggttcgggttctgggaccgacttcactttcaccatctcctcactggaagccgaggatgccgccacttactactgtcagcagcacaacaagtatccgtacaccttcggaggcggtaccaaagtggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1154 - protein, 486 aa, Artificial Sequence
  Description of Artificial Sequence: Synthetic polypeptide
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1155 - protein, 263 aa, Artificial Sequence
  Description of Artificial Sequence: Synthetic polypeptide
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIK

SEQ ID NO: 1156 - protein, 115 aa, Artificial Sequence; identical to SEQ ID NO: 1146
  Description of Artificial Sequence: Synthetic polypeptide

SEQ ID NO: 1157 - protein, 107 aa, Artificial Sequence
  Description of Artificial Sequence: Synthetic polypeptide
DVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIK

SEQ ID NO: 1158 - DNA, 1458 bp, Artificial Sequence
  Description of Artificial Sequence: Synthetic polynucleotide
atggccctccctgtcaccgccctgctgcttccgctggctcttctgctccacgccgctcggccccaagtgcagctggtccagtcgggagccgaagtcaagaagcccggcgctagcgtgaaagtgtcctgcaaagcctccgggtacacattcacctcctactggatgaattgggtcagacaggcgcccggccagggactcgagtggatgggaaggattgatccttacgactccgaaacccattacaaccagaagttcaaggaccgcgtgaccatgactgtggataagtccacttccaccgcttacatggagctgtccagcctgcgctccgaggataccgcagtgtactactgcgcccggggaaactgggacgactattggggacagggaactaccgtgaccgtgtcaagcgggggtggcggtagcggaggagggggctccggcggcggcggctcagggggcggaggaagcgacgtggtcatgactcagtccccggactcactcgcggtgtcgcttggagagagagcgaccatcaactgtcgggcctcaaagagcatcagcaaggacctggcctggtaccagcagaagccgggacagccgccaaagctgctgatctactccgggtccaccttgcaatctggtgtccctgaccggttctccggttccgggtcgggtaccgacttcacgctcactatttcgtcgctgcaagccgaagatgtggccgtgtactattgccaacagcacaacaagtacccctacacttttggcggaggcaccaaggtggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1159 - protein, 486 aa, Artificial Sequence
  Description of Artificial Sequence: Synthetic polypeptide
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1160 - protein, 263 aa, Artificial Sequence
  Description of Artificial Sequence: Synthetic polypeptide
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIK

SEQ ID NO: 1161 - protein, 115 aa, Artificial Sequence; identical to SEQ ID NO: 1146
  Description of Artificial Sequence: Synthetic polypeptide

SEQ ID NO: 1162 - protein, 107 aa, Artificial Sequence
  Description of Artificial Sequence: Synthetic polypeptide
DVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIK

SEQ ID NO: 1163 - DNA, 1458 bp, Artificial Sequence
  Description of Artificial Sequence: Synthetic polynucleotide
atggccctccctgtcaccgccctgctgcttccgctggctcttctgctccacgccgctcggcccgacgtgcagctcacccagtcgccctcatttctgtcggcctcagtgggagacagagtgaccattacttgtcgggcctccaagagcatctccaaggacctggcctggtatcagcagaagccaggaaaggcgcctaagttgctcatctactcggggtcgaccctgcaatctggcgtgccgtcccggttctccggttcgggaagcggtaccgaattcacccttactatctcctccctgcaaccggaggacttcgccacctactactgccaacagcacaacaagtacccgtacactttcgggggtggcacgaaggtcgaaatcaaggggggtggcggtagcggaggagggggctccggcggcggcggctcagggggcggaggaagccaagtgcagctggtccagtcgggagccgaagtcaagaagcccggcgctagcgtgaaagtgtcctgcaaagcctccgggtacacattcacctcctactggatgaattgggtcagacaggcgcccggccagggactcgagtggatgggaaggattgatccttacgactccgaaacccattacaaccagaagttcaaggaccgcgtgaccatgactgtggataagtccacttccaccgcttacatggagctgtccagcctgcgctccgaggataccgcagtgtactactgcgcccggggaaactgggacgactattggggacagggaactaccgtgaccgtgtcaagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1164 - protein, 486 aa, Artificial Sequence
  Description of Artificial Sequence: Synthetic polypeptide
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1165 - protein, 263 aa, Artificial Sequence
  Description of Artificial Sequence: Synthetic polypeptide
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSS

SEQ ID NO: 1166 - protein, 115 aa, Artificial Sequence; identical to SEQ ID NO: 1146
  Description of Artificial Sequence: Synthetic polypeptide

SEQ ID NO: 1167 - protein, 107 aa, Artificial Sequence; identical to SEQ ID NO: 1147
  Description of Artificial Sequence: Synthetic polypeptide

SEQ ID NO: 1168 - DNA, 1458 bp, Artificial Sequence
  Description of Artificial Sequence: Synthetic polynucleotide
atggccctccctgtcaccgccctgctgcttccgctggctcttctgctccacgccgctcggcccgaagtggtgctgacccagtcgcccgcaaccctctctctgtcgccgggagaacgcgccactctttcctgtcgggcgtccaagagcatctcaaaggacctcgcctggtaccagcagaagcctggtcaagccccgcggctgctgatctactccggctccacgctgcaatcaggaatcccagccagattttccggttcggggtcggggactgacttcaccttgaccattagctcgctggaacctgaggacttcgccgtgtattactgccagcagcacaacaagtacccgtacaccttcggaggcggtactaaggtcgagatcaaggggggtggcggtagcggaggagggggctccggcggcggcggctcagggggcggaggaagccaagtgcagctggtccagtcgggagccgaagtcaagaagcccggcgctagcgtgaaagtgtcctgcaaagcctccgggtacacattcacctcctactggatgaattgggtcagacaggcgcccggccagggactcgagtggatgggaaggattgatccttacgactccgaaacccattacaaccagaagttcaaggaccgcgtgaccatgactgtggataagtccacttccaccgcttacatggagctgtccagcctgcgctccgaggataccgcagtgtactactgcgcccggggaaactgggacgactattggggacagggaactaccgtgaccgtgtcaagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1169 - protein, 486 aa, Artificial Sequence
  Description of Artificial Sequence: Synthetic polypeptide
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1170 - protein, 263 aa, Artificial Sequence
  Description of Artificial Sequence: Synthetic polypeptide
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSS

SEQ ID NO: 1171 - protein, 115 aa, Artificial Sequence; identical to SEQ ID NO: 1146
  Description of Artificial Sequence: Synthetic polypeptide

SEQ ID NO: 1172 - protein, 107 aa, Artificial Sequence; identical to SEQ ID NO: 1152
  Description of Artificial Sequence: Synthetic polypeptide

SEQ ID NO: 1173 - DNA, 1458 bp, Artificial Sequence
  Description of Artificial Sequence: Synthetic polynucleotide
atggccctccctgtcaccgccctgctgcttccgctggctcttctgctccacgccgctcggcccgacgtcgtgatgacccagtcaccggcattcctgtccgtgactcccggagaaaaggtcacgattacttgccgggcgtccaagagcatctccaaggacctcgcctggtaccaacagaagccggaccaggcccctaagctgttgatctactcggggtccacccttcaatcgggagtgccatcgcggtttagcggttcgggttctgggaccgacttcactttcaccatctcctcactggaagccgaggatgccgccacttactactgtcagcagcacaacaagtatccgtacaccttcggaggcggtaccaaagtggagatcaaggggggtggcggtagcggaggagggggctccggcggcggcggctcagggggcggaggaagccaagtgcagctggtccagtcgggagccgaagtcaagaagcccggcgctagcgtgaaagtgtcctgcaaagcctccgggtacacattcacctcctactggatgaattgggtcagacaggcgcccggccagggactcgagtggatgggaaggattgatccttacgactccgaaacccattacaaccagaagttcaaggaccgcgtgaccatgactgtggataagtccacttccaccgcttacatggagctgtccagcctgcgctccgaggataccgcagtgtactactgcgcccggggaaactgggacgactattggggacagggaactaccgtgaccgtgtcaagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1174 - protein, 486 aa, Artificial Sequence
  Description of Artificial Sequence: Synthetic polypeptide
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1175 - protein, 263 aa, Artificial Sequence
  Description of Artificial Sequence: Synthetic polypeptide
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSS

SEQ ID NO: 1176 - protein, 115 aa, Artificial Sequence; identical to SEQ ID NO: 1146
  Description of Artificial Sequence: Synthetic polypeptide

SEQ ID NO: 1177 - protein, 107 aa, Artificial Sequence; identical to SEQ ID NO: 1157
  Description of Artificial Sequence: Synthetic polypeptide

SEQ ID NO: 1178 - DNA, 1458 bp, Artificial Sequence
  Description of Artificial Sequence: Synthetic polynucleotide
atggccctccctgtcaccgccctgctgcttccgctggctcttctgctccacgccgctcggcccgacgtggtcatgactcagtccccggactcactcgcggtgtcgcttggagagagagcgaccatcaactgtcgggcctcaaagagcatcagcaaggacctggcctggtaccagcagaagccgggacagccgccaaagctgctgatctactccgggtccaccttgcaatctggtgtccctgaccggttctccggttccgggtcgggtaccgacttcacgctcactatttcgtcgctgcaagccgaagatgtggccgtgtactattgccaacagcacaacaagtacccctacacttttggcggaggcaccaaggtggaaatcaaggggggtggcggtagcggaggagggggctccggcggcggcggctcagggggcggaggaagccaagtgcagctggtccagtcgggagccgaagtcaagaagcccggcgctagcgtgaaagtgtcctgcaaagcctccgggtacacattcacctcctactggatgaattgggtcagacaggcgcccggccagggactcgagtggatgggaaggattgatccttacgactccgaaacccattacaaccagaagttcaaggaccgcgtgaccatgactgtggataagtccacttccaccgcttacatggagctgtccagcctgcgctccgaggataccgcagtgtactactgcgcccggggaaactgggacgactattggggacagggaactaccgtgaccgtgtcaagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1179 - protein, 486 aa, Artificial Sequence
  Description of Artificial Sequence: Synthetic polypeptide
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1180 - protein, 263 aa, Artificial Sequence
  Description of Artificial Sequence: Synthetic polypeptide
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSS

SEQ ID NO: 1181 - protein, 115 aa, Artificial Sequence; identical to SEQ ID NO: 1146
  Description of Artificial Sequence: Synthetic polypeptide

SEQ ID NO: 1182 - protein, 107 aa, Artificial Sequence; identical to SEQ ID NO: 1162
  Description of Artificial Sequence: Synthetic polypeptide

SEQ ID NO: 1183 - DNA, 1458 bp, Artificial Sequence
  Description of Artificial Sequence: Synthetic polynucleotide
atggccctccctgtcaccgccctgctgcttccgctggctcttctgctccacgccgctcggccccaagtgcagctggtgcagtcaggcagcgaactgaagaagcccggagcctccgtcaaagtgtcctgcaaagcctcgggatacaccttcacctcctactggatgaactgggtccgccaggcacctggacaggggctggagtggatgggaaggatcgatccctacgattccgaaacccattacaatcagaagttcaaggaccggtttgtgttctccgtggacaagtccgtgtccaccgcctacctccaaattagcagcctgaaggcggaggatacagctgtctactactgcgctcgcggaaactgggatgactattggggccagggaactaccgtgactgtgtcctccgggggtggcggtagcggaggagggggctccggcggcggcggctcagggggcggaggaagcgacgtgcagctcacccagtcgccctcatttctgtcggcctcagtgggagacagagtgaccattacttgtcgggcctccaagagcatctccaaggacctggcctggtatcagcagaagccaggaaaggcgcctaagttgctcatctactcggggtcgaccctgcaatctggcgtgccgtcccggttctccggttcgggaagcggtaccgaattcacccttactatctcctccctgcaaccggaggacttcgccacctactactgccaacagcacaacaagtacccgtacactttcgggggtggcacgaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1184 - protein, 486 aa, Artificial Sequence
  Description of Artificial Sequence: Synthetic polypeptide
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1185 - protein, 263 aa, Artificial Sequence
  Description of Artificial Sequence: Synthetic polypeptide
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIK

SEQ ID NO: 1186 - protein, 115 aa, Artificial Sequence
  Description of Artificial Sequence: Synthetic polypeptide
QVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSS

SEQ ID NO: 1187 - protein, 107 aa, Artificial Sequence; identical to SEQ ID NO: 1147
  Description of Artificial Sequence: Synthetic polypeptide

SEQ ID NO: 1188 - DNA, 1458 bp, Artificial Sequence
  Description of Artificial Sequence: Synthetic polynucleotide
atggccctccctgtcaccgccctgctgcttccgctggctcttctgctccacgccgctcggccccaagtgcagctggtgcagtcaggcagcgaactgaagaagcccggagcctccgtcaaagtgtcctgcaaagcctcgggatacaccttcacctcctactggatgaactgggtccgccaggcacctggacaggggctggagtggatgggaaggatcgatccctacgattccgaaacccattacaatcagaagttcaaggaccggtttgtgttctccgtggacaagtccgtgtccaccgcctacctccaaattagcagcctgaaggcggaggatacagctgtctactactgcgctcgcggaaactgggatgactattggggccagggaactaccgtgactgtgtcctccgggggtggcggtagcggaggagggggctccggcggcggcggctcagggggcggaggaagcgaagtggtgctgacccagtcgcccgcaaccctctctctgtcgccgggagaacgcgccactctttcctgtcgggcgtccaagagcatctcaaaggacctcgcctggtaccagcagaagcctggtcaagccccgcggctgctgatctactccggctccacgctgcaatcaggaatcccagccagattttccggttcggggtcggggactgacttcaccttgaccattagctcgctggaacctgaggacttcgccgtgtattactgccagcagcacaacaagtacccgtacaccttcggaggcggtactaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1189 - protein, 486 aa, Artificial Sequence
  Description of Artificial Sequence: Synthetic polypeptide
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1190 - protein, 263 aa, Artificial Sequence
  Description of Artificial Sequence: Synthetic polypeptide
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIK

SEQ ID NO: 1191 - protein, 115 aa, Artificial Sequence; identical to SEQ ID NO: 1186
  Description of Artificial Sequence: Synthetic polypeptide

SEQ ID NO: 1192 - protein, 107 aa, Artificial Sequence; identical to SEQ ID NO: 1152
  Description of Artificial Sequence: Synthetic polypeptide

SEQ ID NO: 1193 - DNA, 1458 bp, Artificial Sequence
  Description of Artificial Sequence: Synthetic polynucleotide
atggccctccctgtcaccgccctgctgcttccgctggctcttctgctccacgccgctcggccccaagtgcagctggtgcagtcaggcagcgaactgaagaagcccggagcctccgtcaaagtgtcctgcaaagcctcgggatacaccttcacctcctactggatgaactgggtccgccaggcacctggacaggggctggagtggatgggaaggatcgatccctacgattccgaaacccattacaatcagaagttcaaggaccggtttgtgttctccgtggacaagtccgtgtccaccgcctacctccaaattagcagcctgaaggcggaggatacagctgtctactactgcgctcgcggaaactgggatgactattggggccagggaactaccgtgactgtgtcctccgggggtggcggtagcggaggagggggctccggcggcggcggctcagggggcggaggaagcgacgtcgtgatgacccagtcaccggcattcctgtccgtgactcccggagaaaaggtcacgattacttgccgggcgtccaagagcatctccaaggacctcgcctggtaccaacagaagccggaccaggcccctaagctgttgatctactcggggtccacccttcaatcgggagtgccatcgcggtttagcggttcgggttctgggaccgacttcactttcaccatctcctcactggaagccgaggatgccgccacttactactgtcagcagcacaacaagtatccgtacaccttcggaggcggtaccaaagtggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1194 - protein, 486 aa, Artificial Sequence
  Description of Artificial Sequence: Synthetic polypeptide
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1195 - protein, 263 aa, Artificial Sequence
  Description of Artificial Sequence: Synthetic polypeptide
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIK

SEQ ID NO: 1196 - protein, 115 aa, Artificial Sequence; identical to SEQ ID NO: 1186
  Description of Artificial Sequence: Synthetic polypeptide

SEQ ID NO: 1197 - protein, 107 aa, Artificial Sequence; identical to SEQ ID NO: 1157
  Description of Artificial Sequence: Synthetic polypeptide

SEQ ID NO: 1198 - DNA, 1458 bp, Artificial Sequence
  Description of Artificial Sequence: Synthetic polynucleotide
atggccctccctgtcaccgccctgctgcttccgctggctcttctgctccacgccgctcggccccaagtgcagctggtgcagtcaggcagcgaactgaagaagcccggagcctccgtcaaagtgtcctgcaaagcctcgggatacaccttcacctcctactggatgaactgggtccgccaggcacctggacaggggctggagtggatgggaaggatcgatccctacgattccgaaacccattacaatcagaagttcaaggaccggtttgtgttctccgtggacaagtccgtgtccaccgcctacctccaaattagcagcctgaaggcggaggatacagctgtctactactgcgctcgcggaaactgggatgactattggggccagggaactaccgtgactgtgtcctccgggggtggcggtagcggaggagggggctccggcggcggcggctcagggggcggaggaagcgacgtggtcatgactcagtccccggactcactcgcggtgtcgcttggagagagagcgaccatcaactgtcgggcctcaaagagcatcagcaaggacctggcctggtaccagcagaagccgggacagccgccaaagctgctgatctactccgggtccaccttgcaatctggtgtccctgaccggttctccggttccgggtcgggtaccgacttcacgctcactatttcgtcgctgcaagccgaagatgtggccgtgtactattgccaacagcacaacaagtacccctacacttttggcggaggcaccaaggtggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1199 - protein, 486 aa, Artificial Sequence
  Description of Artificial Sequence: Synthetic polypeptide
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1200 - protein, 263 aa, Artificial Sequence
  Description of Artificial Sequence: Synthetic polypeptide
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIK

SEQ ID NO: 1201 - protein, 115 aa, Artificial Sequence; identical to SEQ ID NO: 1186
  Description of Artificial Sequence: Synthetic polypeptide

SEQ ID NO: 1202 - protein, 107 aa, Artificial Sequence; identical to SEQ ID NO: 1162
  Description of Artificial Sequence: Synthetic polypeptide

SEQ ID NO: 1203 - DNA, 1458 bp, Artificial Sequence
  Description of Artificial Sequence: Synthetic polynucleotide
atggccctccctgtcaccgccctgctgcttccgctggctcttctgctccacgccgctcggcccgacgtgcagctcacccagtcgccctcatttctgtcggcctcagtgggagacagagtgaccattacttgtcgggcctccaagagcatctccaaggacctggcctggtatcagcagaagccaggaaaggcgcctaagttgctcatctactcggggtcgaccctgcaatctggcgtgccgtcccggttctccggttcgggaagcggtaccgaattcacccttactatctcctccctgcaaccggaggacttcgccacctactactgccaacagcacaacaagtacccgtacactttcgggggtggcacgaaggtcgaaatcaaggggggtggcggtagcggaggagggggctccggcggcggcggctcagggggcggaggaagccaagtgcagctggtgcagtcaggcagcgaactgaagaagcccggagcctccgtcaaagtgtcctgcaaagcctcgggatacaccttcacctcctactggatgaactgggtccgccaggcacctggacaggggctggagtggatgggaaggatcgatccctacgattccgaaacccattacaatcagaagttcaaggaccggtttgtgttctccgtggacaagtccgtgtccaccgcctacctccaaattagcagcctgaaggcggaggatacagctgtctactactgcgctcgcggaaactgggatgactattggggccagggaactaccgtgactgtgtcctccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1204 - protein, 486 aa, Artificial Sequence
  Description of Artificial Sequence: Synthetic polypeptide
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1205 - protein, 263 aa, Artificial Sequence
  Description of Artificial Sequence: Synthetic polypeptide
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSS

SEQ ID NO: 1206 - protein, 115 aa, Artificial Sequence; identical to SEQ ID NO: 1186
  Description of Artificial Sequence: Synthetic polypeptide

SEQ ID NO: 1207 - protein, 107 aa, Artificial Sequence; identical to SEQ ID NO: 1147
  Description of Artificial Sequence: Synthetic polypeptide

SEQ ID NO: 1208 - DNA, 1458 bp, Artificial Sequence
  Description of Artificial Sequence: Synthetic polynucleotide
atggccctccctgtcaccgccctgctgcttccgctggctcttctgctccacgccgctcggcccgaagtggtgctgacccagtcgcccgcaaccctctctctgtcgccgggagaacgcgccactctttcctgtcgggcgtccaagagcatctcaaaggacctcgcctggtaccagcagaagcctggtcaagccccgcggctgctgatctactccggctccacgctgcaatcaggaatcccagccagattttccggttcggggtcggggactgacttcaccttgaccattagctcgctggaacctgaggacttcgccgtgtattactgccagcagcacaacaagtacccgtacaccttcggaggcggtactaaggtcgagatcaaggggggtggcggtagcggaggagggggctccggcggcggcggctcagggggcggaggaagccaagtgcagctggtgcagtcaggcagcgaactgaagaagcccggagcctccgtcaaagtgtcctgcaaagcctcgggatacaccttcacctcctactggatgaactgggtccgccaggcacctggacaggggctggagtggatgggaaggatcgatccctacgattccgaaacccattacaatcagaagttcaaggaccggtttgtgttctccgtggacaagtccgtgtccaccgcctacctccaaattagcagcctgaaggcggaggatacagctgtctactactgcgctcgcggaaactgggatgactattggggccagggaactaccgtgactgtgtcctccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1209 - protein, 486 aa, Artificial Sequence
  Description of Artificial Sequence: Synthetic polypeptide
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1210 - protein, 263 aa, Artificial Sequence
  Description of Artificial Sequence: Synthetic polypeptide
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSS

SEQ ID NO: 1211 - protein, 115 aa, Artificial Sequence; identical to SEQ ID NO: 1186
  Description of Artificial Sequence: Synthetic polypeptide

SEQ ID NO: 1212 - protein, 107 aa, Artificial Sequence; identical to SEQ ID NO: 1152
  Description of Artificial Sequence: Synthetic polypeptide

SEQ ID NO: 1213 - DNA, 1458 bp, Artificial Sequence
  Description of Artificial Sequence: Synthetic polynucleotide
atggccctccctgtcaccgccctgctgcttccgctggctcttctgctccacgccgctcggcccgacgtcgtgatgacccagtcaccggcattcctgtccgtgactcccggagaaaaggtcacgattacttgccgggcgtccaagagcatctccaaggacctcgcctggtaccaacagaagccggaccaggcccctaagctgttgatctactcggggtccacccttcaatcgggagtgccatcgcggtttagcggttcgggttctgggaccgacttcactttcaccatctcctcactggaagccgaggatgccgccacttactactgtcagcagcacaacaagtatccgtacaccttcggaggcggtaccaaagtggagatcaaggggggtggcggtagcggaggagggggctccggcggcggcggctcagggggcggaggaagccaagtgcagctggtgcagtcaggcagcgaactgaagaagcccggagcctccgtcaaagtgtcctgcaaagcctcgggatacaccttcacctcctactggatgaactgggtccgccaggcacctggacaggggctggagtggatgggaaggatcgatccctacgattccgaaacccattacaatcagaagttcaaggaccggtttgtgttctccgtggacaagtccgtgtccaccgcctacctccaaattagcagcctgaaggcggaggatacagctgtctactactgcgctcgcggaaactgggatgactattggggccagggaactaccgtgactgtgtcctccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1214 - protein, 486 aa, Artificial Sequence
  Description of Artificial Sequence: Synthetic polypeptide
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1215 - protein, 263 aa, Artificial Sequence
  Description of Artificial Sequence: Synthetic polypeptide
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSS

SEQ ID NO: 1216 - protein, 115 aa, Artificial Sequence; identical to SEQ ID NO: 1186
  Description of Artificial Sequence: Synthetic polypeptide

SEQ ID NO: 1217 - protein, 107 aa, Artificial Sequence; identical to SEQ ID NO: 1157
  Description of Artificial Sequence: Synthetic polypeptide

SEQ ID NO: 1218 - DNA, 1458 bp, Artificial Sequence
  Description of Artificial Sequence: Synthetic polynucleotide
atggccctccctgtcaccgccctgctgcttccgctggctcttctgctccacgccgctcggcccgacgtggtcatgactcagtccccggactcactcgcggtgtcgcttggagagagagcgaccatcaactgtcgggcctcaaagagcatcagcaaggacctggcctggtaccagcagaagccgggacagccgccaaagctgctgatctactccgggtccaccttgcaatctggtgtccctgaccggttctccggttccgggtcgggtaccgacttcacgctcactatttcgtcgctgcaagccgaagatgtggccgtgtactattgccaacagcacaacaagtacccctacacttttggcggaggcaccaaggtggaaatcaaggggggtggcggtagcggaggagggggctccggcggcggcggctcagggggcggaggaagccaagtgcagctggtgcagtcaggcagcgaactgaagaagcccggagcctccgtcaaagtgtcctgcaaagcctcgggatacaccttcacctcctactggatgaactgggtccgccaggcacctggacaggggctggagtggatgggaaggatcgatccctacgattccgaaacccattacaatcagaagttcaaggaccggtttgtgttctccgtggacaagtccgtgtccaccgcctacctccaaattagcagcctgaaggcggaggatacagctgtctactactgcgctcgcggaaactgggatgactattggggccagggaactaccgtgactgtgtcctccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1219 - protein, 486 aa, Artificial Sequence
  Description of Artificial Sequence: Synthetic polypeptide
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1220 - protein, 263 aa, Artificial Sequence
  Description of Artificial Sequence: Synthetic polypeptide
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSS

SEQ ID NO: 1221 - protein, 115 aa, Artificial Sequence; identical to SEQ ID NO: 1186
  Description of Artificial Sequence: Synthetic polypeptide

SEQ ID NO: 1222 - protein, 107 aa, Artificial Sequence; identical to SEQ ID NO: 1162
  Description of Artificial Sequence: Synthetic polypeptide

SEQ ID NO: 1223 - DNA, 1458 bp, Artificial Sequence
  Description of Artificial Sequence: Synthetic polynucleotide
atggccctccctgtcaccgccctgctgcttccgctggctcttctgctccacgccgctcggcccgaggtgcagctggtgcagagcggagccgaggtcaagaagcctggagaatccctgaggatcagctgcaaaggcagcgggtataccttcacctcctactggatgaattgggtccgccagatgcccggaaaaggcctggagtggatgggacggattgacccctacgactcggaaacccattacaaccagaagttcaaggatcacgtgaccatctccgtggacaagtccatttccactgcgtacctccagtggtcaagcctgaaggcctccgacactgctatgtactactgcgcacgcggaaactgggatgattactggggacagggaacaaccgtgactgtgtcctccgggggtggcggtagcggaggagggggctccggcggcggcggctcagggggcggaggaagcgacgtgcagctcacccagtcgccctcatttctgtcggcctcagtgggagacagagtgaccattacttgtcgggcctccaagagcatctccaaggacctggcctggtatcagcagaagccaggaaaggcgcctaagttgctcatctactcggggtcgaccctgcaatctggcgtgccgtcccggttctccggttcgggaagcggtaccgaattcacccttactatctcctccctgcaaccggaggacttcgccacctactactgccaacagcacaacaagtacccgtacactttcgggggtggcacgaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1224 - protein, 486 aa, Artificial Sequence
  Description of Artificial Sequence: Synthetic polypeptide
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1225 - protein, 263 aa, Artificial Sequence
  Description of Artificial Sequence: Synthetic polypeptide
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIK

SEQ ID NO: 1226 - protein, 115 aa, Artificial Sequence
  Description of Artificial Sequence: Synthetic polypeptide
EVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSS

SEQ ID NO: 1227 - protein, 107 aa, Artificial Sequence; identical to SEQ ID NO: 1147
  Description of Artificial Sequence: Synthetic polypeptide

SEQ ID NO: 1228 - DNA, 1458 bp, Artificial Sequence
  Description of Artificial Sequence: Synthetic polynucleotide
atggccctccctgtcaccgccctgctgcttccgctggctcttctgctccacgccgctcggcccgaggtgcagctggtgcagagcggagccgaggtcaagaagcctggagaatccctgaggatcagctgcaaaggcagcgggtataccttcacctcctactggatgaattgggtccgccagatgcccggaaaaggcctggagtggatgggacggattgacccctacgactcggaaacccattacaaccagaagttcaaggatcacgtgaccatctccgtggacaagtccatttccactgcgtacctccagtggtcaagcctgaaggcctccgacactgctatgtactactgcgcacgcggaaactgggatgattactggggacagggaacaaccgtgactgtgtcctccgggggtggcggtagcggaggagggggctccggcggcggcggctcagggggcggaggaagcgaagtggtgctgacccagtcgcccgcaaccctctctctgtcgccgggagaacgcgccactctttcctgtcgggcgtccaagagcatctcaaaggacctcgcctggtaccagcagaagcctggtcaagccccgcggctgctgatctactccggctccacgctgcaatcaggaatcccagccagattttccggttcggggtcggggactgacttcaccttgaccattagctcgctggaacctgaggacttcgccgtgtattactgccagcagcacaacaagtacccgtacaccttcggaggcggtactaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1229 - protein, 486 aa, Artificial Sequence
  Description of Artificial Sequence: Synthetic polypeptide
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1230 - protein, 263 aa, Artificial Sequence
  Description of Artificial Sequence: Synthetic polypeptide
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIK

SEQ ID NO: 1231 - protein, 115 aa, Artificial Sequence; identical to SEQ ID NO: 1226
  Description of Artificial Sequence: Synthetic polypeptide

SEQ ID NO: 1232 - protein, 107 aa, Artificial Sequence; identical to SEQ ID NO: 1152
  Description of Artificial Sequence: Synthetic polypeptide

SEQ ID NO: 1233 - DNA, 1458 bp, Artificial Sequence
  Description of Artificial Sequence: Synthetic polynucleotide
atggccctccctgtcaccgccctgctgcttccgctggctcttctgctccacgccgctcggcccgaggtgcagctggtgcagagcggagccgaggtcaagaagcctggagaatccctgaggatcagctgcaaaggcagcgggtataccttcacctcctactggatgaattgggtccgccagatgcccggaaaaggcctggagtggatgggacggattgacccctacgactcggaaacccattacaaccagaagttcaaggatcacgtgaccatctccgtggacaagtccatttccactgcgtacctccagtggtcaagcctgaaggcctccgacactgctatgtactactgcgcacgcggaaactgggatgattactggggacagggaacaaccgtgactgtgtcctccgggggtggcggtagcggaggagggggctccggcggcggcggctcagggggcggaggaagcgacgtcgtgatgacccagtcaccggcattcctgtccgtgactcccggagaaaaggtcacgattacttgccgggcgtccaagagcatctccaaggacctcgcctggtaccaacagaagccggaccaggcccctaagctgttgatctactcggggtccacccttcaatcgggagtgccatcgcggtttagcggttcgggttctgggaccgacttcactttcaccatctcctcactggaagccgaggatgccgccacttactactgtcagcagcacaacaagtatccgtacaccttcggaggcggtaccaaagtggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1234 - protein, 486 aa, Artificial Sequence
  Description of Artificial Sequence: Synthetic polypeptide
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1235 - protein, 263 aa, Artificial Sequence
  Description of Artificial Sequence: Synthetic polypeptide
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIK

SEQ ID NO: 1236 - protein, 115 aa, Artificial Sequence; identical to SEQ ID NO: 1226
  Description of Artificial Sequence: Synthetic polypeptide

SEQ ID NO: 1237 - protein, 107 aa, Artificial Sequence; identical to SEQ ID NO: 1157
  Description of Artificial Sequence: Synthetic polypeptide

SEQ ID NO: 1238 - DNA, 1458 bp, Artificial Sequence
  Description of Artificial Sequence: Synthetic polynucleotide
atggccctccctgtcaccgccctgctgcttccgctggctcttctgctccacgccgctcggcccgaggtgcagctggtgcagagcggagccgaggtcaagaagcctggagaatccctgaggatcagctgcaaaggcagcgggtataccttcacctcctactggatgaattgggtccgccagatgcccggaaaaggcctggagtggatgggacggattgacccctacgactcggaaacccattacaaccagaagttcaaggatcacgtgaccatctccgtggacaagtccatttccactgcgtacctccagtggtcaagcctgaaggcctccgacactgctatgtactactgcgcacgcggaaactgggatgattactggggacagggaacaaccgtgactgtgtcctccgggggtggcggtagcggaggagggggctccggcggcggcggctcagggggcggaggaagcgacgtggtcatgactcagtccccggactcactcgcggtgtcgcttggagagagagcgaccatcaactgtcgggcctcaaagagcatcagcaaggacctggcctggtaccagcagaagccgggacagccgccaaagctgctgatctactccgggtccaccttgcaatctggtgtccctgaccggttctccggttccgggtcgggtaccgacttcacgctcactatttcgtcgctgcaagccgaagatgtggccgtgtactattgccaacagcacaacaagtacccctacacttttggcggaggcaccaaggtggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1239 - protein, 486 aa, Artificial Sequence
  Description of Artificial Sequence: Synthetic polypeptide
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1240 - protein, 263 aa, Artificial Sequence
  Description of Artificial Sequence: Synthetic polypeptide
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIK

SEQ ID NO: 1241 - protein, 115 aa, Artificial Sequence; identical to SEQ ID NO: 1226
  Description of Artificial Sequence: Synthetic polypeptide

SEQ ID NO: 1242 - protein, 107 aa, Artificial Sequence; identical to SEQ ID NO: 1162
  Description of Artificial Sequence: Synthetic polypeptide

SEQ ID NO: 1243 - DNA, 1458 bp, Artificial Sequence
  Description of Artificial Sequence: Synthetic polynucleotide
atggccctccctgtcaccgccctgctgcttccgctggctcttctgctccacgccgctcggcccgacgtgcagctcacccagtcgccctcatttctgtcggcctcagtgggagacagagtgaccattacttgtcgggcctccaagagcatctccaaggacctggcctggtatcagcagaagccaggaaaggcgcctaagttgctcatctactcggggtcgaccctgcaatctggcgtgccgtcccggttctccggttcgggaagcggtaccgaattcacccttactatctcctccctgcaaccggaggacttcgccacctactactgccaacagcacaacaagtacccgtacactttcgggggtggcacgaaggtcgaaatcaaggggggtggcggtagcggaggagggggctccggcggcggcggctcagggggcggaggaagcgaggtgcagctggtgcagagcggagccgaggtcaagaagcctggagaatccctgaggatcagctgcaaaggcagcgggtataccttcacctcctactggatgaattgggtccgccagatgcccggaaaaggcctggagtggatgggacggattgacccctacgactcggaaacccattacaaccagaagttcaaggatcacgtgaccatctccgtggacaagtccatttccactgcgtacctccagtggtcaagcctgaaggcctccgacactgctatgtactactgcgcacgcggaaactgggatgattactggggacagggaacaaccgtgactgtgtcctccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1244 - protein, 486 aa, Artificial Sequence
  Description of Artificial Sequence: Synthetic polypeptide
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1245 - protein, 263 aa, Artificial Sequence
  Description of Artificial Sequence: Synthetic polypeptide
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSS

SEQ ID NO: 1246 - protein, 115 aa, Artificial Sequence; identical to SEQ ID NO: 1226
  Description of Artificial Sequence: Synthetic polypeptide

SEQ ID NO: 1247 - protein, 107 aa, Artificial Sequence; identical to SEQ ID NO: 1147
  Description of Artificial Sequence: Synthetic polypeptide

SEQ ID NO: 1248 - DNA, 1458 bp, Artificial Sequence
  Description of Artificial Sequence: Synthetic polynucleotide
atggccctccctgtcaccgccctgctgcttccgctggctcttctgctccacgccgctcggcccgaagtggtgctgacccagtcgcccgcaaccctctctctgtcgccgggagaacgcgccactctttcctgtcgggcgtccaagagcatctcaaaggacctcgcctggtaccagcagaagcctggtcaagccccgcggctgctgatctactccggctccacgctgcaatcaggaatcccagccagattttccggttcggggtcggggactgacttcaccttgaccattagctcgctggaacctgaggacttcgccgtgtattactgccagcagcacaacaagtacccgtacaccttcggaggcggtactaaggtcgagatcaaggggggtggcggtagcggaggagggggctccggcggcggcggctcagggggcggaggaagcgaggtgcagctggtgcagagcggagccgaggtcaagaagcctggagaatccctgaggatcagctgcaaaggcagcgggtataccttcacctcctactggatgaattgggtccgccagatgcccggaaaaggcctggagtggatgggacggattgacccctacgactcggaaacccattacaaccagaagttcaaggatcacgtgaccatctccgtggacaagtccatttccactgcgtacctccagtggtcaagcctgaaggcctccgacactgctatgtactactgcgcacgcggaaactgggatgattactggggacagggaacaaccgtgactgtgtcctccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1249 - protein, 486 aa, Artificial Sequence
  Description of Artificial Sequence: Synthetic polypeptide
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1250 - protein, 263 aa, Artificial Sequence
  Description of Artificial Sequence: Synthetic polypeptide
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSS

SEQ ID NO: 1251 - protein, 115 aa, Artificial Sequence; identical to SEQ ID NO: 1226
  Description of Artificial Sequence: Synthetic polypeptide

SEQ ID NO: 1252 - protein, 107 aa, Artificial Sequence; identical to SEQ ID NO: 1152
  Description of Artificial Sequence: Synthetic polypeptide

SEQ ID NO: 1253 - DNA, 1458 bp, Artificial Sequence
  Description of Artificial Sequence: Synthetic polynucleotide
atggccctccctgtcaccgccctgctgcttccgctggctcttctgctccacgccgctcggcccgacgtcgtgatgacccagtcaccggcattcctgtccgtgactcccggagaaaaggtcacgattacttgccgggcgtccaagagcatctccaaggacctcgcctggtaccaacagaagccggaccaggcccctaagctgttgatctactcggggtccacccttcaatcgggagtgccatcgcggtttagcggttcgggttctgggaccgacttcactttcaccatctcctcactggaagccgaggatgccgccacttactactgtcagcagcacaacaagtatccgtacaccttcggaggcggtaccaaagtggagatcaaggggggtggcggtagcggaggagggggctccggcggcggcggctcagggggcggaggaagcgaggtgcagctggtgcagagcggagccgaggtcaagaagcctggagaatccctgaggatcagctgcaaaggcagcgggtataccttcacctcctactggatgaattgggtccgccagatgcccggaaaaggcctggagtggatgggacggattgacccctacgactcggaaacccattacaaccagaagttcaaggatcacgtgaccatctccgtggacaagtccatttccactgcgtacctccagtggtcaagcctgaaggcctccgacactgctatgtactactgcgcacgcggaaactgggatgattactggggacagggaacaaccgtgactgtgtcctccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1254 - protein, 486 aa, Artificial Sequence
  Description of Artificial Sequence: Synthetic polypeptide
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1255 - protein, 263 aa, Artificial Sequence
  Description of Artificial Sequence: Synthetic polypeptide
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSS

SEQ ID NO: 1256 - protein, 115 aa, Artificial Sequence; identical to SEQ ID NO: 1226
  Description of Artificial Sequence: Synthetic polypeptide

SEQ ID NO: 1257 - protein, 107 aa, Artificial Sequence; identical to SEQ ID NO: 1157
  Description of Artificial Sequence: Synthetic polypeptide

SEQ ID NO: 1258 - DNA, 1458 bp, Artificial Sequence
  Description of Artificial Sequence: Synthetic polynucleotide
atggccctccctgtcaccgccctgctgcttccgctggctcttctgctccacgccgctcggcccgacgtggtcatgactcagtccccggactcactcgcggtgtcgcttggagagagagcgaccatcaactgtcgggcctcaaagagcatcagcaaggacctggcctggtaccagcagaagccgggacagccgccaaagctgctgatctactccgggtccaccttgcaatctggtgtccctgaccggttctccggttccgggtcgggtaccgacttcacgctcactatttcgtcgctgcaagccgaagatgtggccgtgtactattgccaacagcacaacaagtacccctacacttttggcggaggcaccaaggtggaaatcaaggggggtggcggtagcggaggagggggctccggcggcggcggctcagggggcggaggaagcgaggtgcagctggtgcagagcggagccgaggtcaagaagcctggagaatccctgaggatcagctgcaaaggcagcgggtataccttcacctcctactggatgaattgggtccgccagatgcccggaaaaggcctggagtggatgggacggattgacccctacgactcggaaacccattacaaccagaagttcaaggatcacgtgaccatctccgtggacaagtccatttccactgcgtacctccagtggtcaagcctgaaggcctccgacactgctatgtactactgcgcacgcggaaactgggatgattactggggacagggaacaaccgtgactgtgtcctccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1259 - protein, 486 aa, Artificial Sequence
  Description of Artificial Sequence: Synthetic polypeptide
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1260 - protein, 263 aa, Artificial Sequence
  Description of Artificial Sequence: Synthetic polypeptide
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSS

SEQ ID NO: 1261 - protein, 115 aa, Artificial Sequence; identical to SEQ ID NO: 1226
  Description of Artificial Sequence: Synthetic polypeptide

SEQ ID NO: 1262 - protein, 107 aa, Artificial Sequence; identical to SEQ ID NO: 1162
  Description of Artificial Sequence: Synthetic polypeptide

SEQ ID NO: 1263 - DNA, 1458 bp, Artificial Sequence
  Description of Artificial Sequence: Synthetic polynucleotide
atggccctccctgtcaccgccctgctgcttccgctggctcttctgctccacgccgctcggcccgaagtgcagctcgtcgagagcggagggggactggtgcagcccggaggaagcctgaggctgtcctgcgctgcctccggctacaccttcacctcctactggatgaactgggtcagacaggcacctggaaagggactggtctgggtgtcgcgcattgacccctacgactccgaaacccattacaatcagaaattcaaggaccgcttcaccatctccgtggacaaagccaagagcaccgcgtacctccaaatgaactccctgcgcgctgaggatacagcagtgtactattgcgcccggggaaactgggatgattactggggccagggaactactgtgactgtgtcatccgggggtggcggtagcggaggagggggctccggcggcggcggctcagggggcggaggaagcgacgtgcagctcacccagtcgccctcatttctgtcggcctcagtgggagacagagtgaccattacttgtcgggcctccaagagcatctccaaggacctggcctggtatcagcagaagccaggaaaggcgcctaagttgctcatctactcggggtcgaccctgcaatctggcgtgccgtcccggttctccggttcgggaagcggtaccgaattcacccttactatctcctccctgcaaccggaggacttcgccacctactactgccaacagcacaacaagtacccgtacactttcgggggtggcacgaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1264 - protein, 486 aa, Artificial Sequence
  Description of Artificial Sequence: Synthetic polypeptide
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1265 - protein, 263 aa, Artificial Sequence
  Description of Artificial Sequence: Synthetic polypeptide
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIK

SEQ ID NO: 1266 - protein, 115 aa, Artificial Sequence
  Description of Artificial Sequence: Synthetic polypeptide
EVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSS

SEQ ID NO: 1267 - protein, 107 aa, Artificial Sequence; identical to SEQ ID NO: 1147
  Description of Artificial Sequence: Synthetic polypeptide

SEQ ID NO: 1268 - DNA, 1458 bp, Artificial Sequence
  Description of Artificial Sequence: Synthetic polynucleotide
atggccctccctgtcaccgccctgctgcttccgctggctcttctgctccacgccgctcggcccgaagtgcagctcgtcgagagcggagggggactggtgcagcccggaggaagcctgaggctgtcctgcgctgcctccggctacaccttcacctcctactggatgaactgggtcagacaggcacctggaaagggactggtctgggtgtcgcgcattgacccctacgactccgaaacccattacaatcagaaattcaaggaccgcttcaccatctccgtggacaaagccaagagcaccgcgtacctccaaatgaactccctgcgcgctgaggatacagcagtgtactattgcgcccggggaaactgggatgattactggggccagggaactactgtgactgtgtcatccgggggtggcggtagcggaggagggggctccggcggcggcggctcagggggcggaggaagcgaagtggtgctgacccagtcgcccgcaaccctctctctgtcgccgggagaacgcgccactctttcctgtcgggcgtccaagagcatctcaaaggacctcgcctggtaccagcagaagcctggtcaagccccgcggctgctgatctactccggctccacgctgcaatcaggaatcccagccagattttccggttcggggtcggggactgacttcaccttgaccattagctcgctggaacctgaggacttcgccgtgtattactgccagcagcacaacaagtacccgtacaccttcggaggcggtactaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1269 - protein, 486 aa, Artificial Sequence
  Description of Artificial Sequence: Synthetic polypeptide
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1270 - protein, 263 aa, Artificial Sequence
  Description of Artificial Sequence: Synthetic polypeptide
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIK

SEQ ID NO: 1271 - protein, 115 aa, Artificial Sequence; identical to SEQ ID NO: 1266
  Description of Artificial Sequence: Synthetic polypeptide

SEQ ID NO: 1272 - protein, 107 aa, Artificial Sequence; identical to SEQ ID NO: 1152
  Description of Artificial Sequence: Synthetic polypeptide

SEQ ID NO: 1273 - DNA, 1458 bp, Artificial Sequence
  Description of Artificial Sequence: Synthetic polynucleotide
atggccctccctgtcaccgccctgctgcttccgctggctcttctgctccacgccgctcggcccgaagtgcagctcgtcgagagcggagggggactggtgcagcccggaggaagcctgaggctgtcctgcgctgcctccggctacaccttcacctcctactggatgaactgggtcagacaggcacctggaaagggactggtctgggtgtcgcgcattgacccctacgactccgaaacccattacaatcagaaattcaaggaccgcttcaccatctccgtggacaaagccaagagcaccgcgtacctccaaatgaactccctgcgcgctgaggatacagcagtgtactattgcgcccggggaaactgggatgattactggggccagggaactactgtgactgtgtcatccgggggtggcggtagcggaggagggggctccggcggcggcggctcagggggcggaggaagcgacgtcgtgatgacccagtcaccggcattcctgtccgtgactcccggagaaaaggtcacgattacttgccgggcgtccaagagcatctccaaggacctcgcctggtaccaacagaagccggaccaggcccctaagctgttgatctactcggggtccacccttcaatcgggagtgccatcgcggtttagcggttcgggttctgggaccgacttcactttcaccatctcctcactggaagccgaggatgccgccacttactactgtcagcagcacaacaagtatccgtacaccttcggaggcggtaccaaagtggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1274 - protein, 486 aa, Artificial Sequence
  Description of Artificial Sequence: Synthetic polypeptide
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1275 - protein, 263 aa, Artificial Sequence
  Description of Artificial Sequence: Synthetic polypeptide
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIK

SEQ ID NO: 1276 - protein, 115 aa, Artificial Sequence; identical to SEQ ID NO: 1266
  Description of Artificial Sequence: Synthetic polypeptide

SEQ ID NO: 1277 - protein, 107 aa, Artificial Sequence; identical to SEQ ID NO: 1157
  Description of Artificial Sequence: Synthetic polypeptide

SEQ ID NO: 1278 - DNA, 1458 bp, Artificial Sequence
  Description of Artificial Sequence: Synthetic polynucleotide
atggccctccctgtcaccgccctgctgcttccgctggctcttctgctccacgccgctcggcccgaagtgcagctcgtcgagagcggagggggactggtgcagcccggaggaagcctgaggctgtcctgcgctgcctccggctacaccttcacctcctactggatgaactgggtcagacaggcacctggaaagggactggtctgggtgtcgcgcattgacccctacgactccgaaacccattacaatcagaaattcaaggaccgcttcaccatctccgtggacaaagccaagagcaccgcgtacctccaaatgaactccctgcgcgctgaggatacagcagtgtactattgcgcccggggaaactgggatgattactggggccagggaactactgtgactgtgtcatccgggggtggcggtagcggaggagggggctccggcggcggcggctcagggggcggaggaagcgacgtggtcatgactcagtccccggactcactcgcggtgtcgcttggagagagagcgaccatcaactgtcgggcctcaaagagcatcagcaaggacctggcctggtaccagcagaagccgggacagccgccaaagctgctgatctactccgggtccaccttgcaatctggtgtccctgaccggttctccggttccgggtcgggtaccgacttcacgctcactatttcgtcgctgcaagccgaagatgtggccgtgtactattgccaacagcacaacaagtacccctacacttttggcggaggcaccaaggtggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1279 - protein, 486 aa, Artificial Sequence
  Description of Artificial Sequence: Synthetic polypeptide
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1280 - protein, 263 aa, Artificial Sequence
  Description of Artificial Sequence: Synthetic polypeptide
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIK

SEQ ID NO: 1281 - protein, 115 aa, Artificial Sequence; identical to SEQ ID NO: 1266
  Description of Artificial Sequence: Synthetic polypeptide

SEQ ID NO: 1282 - protein, 107 aa, Artificial Sequence; identical to SEQ ID NO: 1162
  Description of Artificial Sequence: Synthetic polypeptide

SEQ ID NO: 1283 - DNA, 1458 bp, Artificial Sequence
  Description of Artificial Sequence: Synthetic polynucleotide
atggccctccctgtcaccgccctgctgcttccgctggctcttctgctccacgccgctcggcccgacgtgcagctcacccagtcgccctcatttctgtcggcctcagtgggagacagagtgaccattacttgtcgggcctccaagagcatctccaaggacctggcctggtatcagcagaagccaggaaaggcgcctaagttgctcatctactcggggtcgaccctgcaatctggcgtgccgtcccggttctccggttcgggaagcggtaccgaattcacccttactatctcctccctgcaaccggaggacttcgccacctactactgccaacagcacaacaagtacccgtacactttcgggggtggcacgaaggtcgaaatcaaggggggtggcggtagcggaggagggggctccggcggcggcggctcagggggcggaggaagcgaagtgcagctcgtcgagagcggagggggactggtgcagcccggaggaagcctgaggctgtcctgcgctgcctccggctacaccttcacctcctactggatgaactgggtcagacaggcacctggaaagggactggtctgggtgtcgcgcattgacccctacgactccgaaacccattacaatcagaaattcaaggaccgcttcaccatctccgtggacaaagccaagagcaccgcgtacctccaaatgaactccctgcgcgctgaggatacagcagtgtactattgcgcccggggaaactgggatgattactggggccagggaactactgtgactgtgtcatccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1284 - protein, 486 aa, Artificial Sequence
  Description of Artificial Sequence: Synthetic polypeptide
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1285 - protein, 263 aa, Artificial Sequence
  Description of Artificial Sequence: Synthetic polypeptide
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSS

SEQ ID NO: 1286 - protein, 115 aa, Artificial Sequence; identical to SEQ ID NO: 1266
  Description of Artificial Sequence: Synthetic polypeptide

SEQ ID NO: 1287 - protein, 107 aa, Artificial Sequence; identical to SEQ ID NO: 1147
  Description of Artificial Sequence: Synthetic polypeptide

SEQ ID NO: 1288 - DNA, 1458 bp, Artificial Sequence
  Description of Artificial Sequence: Synthetic polynucleotide
atggccctccctgtcaccgccctgctgcttccgctggctcttctgctccacgccgctcggcccgaagtggtgctgacccagtcgcccgcaaccctctctctgtcgccgggagaacgcgccactctttcctgtcgggcgtccaagagcatctcaaaggacctcgcctggtaccagcagaagcctggtcaagccccgcggctgctgatctactccggctccacgctgcaatcaggaatcccagccagattttccggttcggggtcggggactgacttcaccttgaccattagctcgctggaacctgaggacttcgccgtgtattactgccagcagcacaacaagtacccgtacaccttcggaggcggtactaaggtcgagatcaaggggggtggcggtagcggaggagggggctccggcggcggcggctcagggggcggaggaagcgaagtgcagctcgtcgagagcggagggggactggtgcagcccggaggaagcctgaggctgtcctgcgctgcctccggctacaccttcacctcctactggatgaactgggtcagacaggcacctggaaagggactggtctgggtgtcgcgcattgacccctacgactccgaaacccattacaatcagaaattcaaggaccgcttcaccatctccgtggacaaagccaagagcaccgcgtacctccaaatgaactccctgcgcgctgaggatacagcagtgtactattgcgcccggggaaactgggatgattactggggccagggaactactgtgactgtgtcatccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1289 - protein, 486 aa, Artificial Sequence
  Description of Artificial Sequence: Synthetic polypeptide
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1290 - protein, 263 aa, Artificial Sequence
  Description of Artificial Sequence: Synthetic polypeptide
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSS

SEQ ID NO: 1291 - protein, 115 aa, Artificial Sequence; identical to SEQ ID NO: 1266
  Description of Artificial Sequence: Synthetic polypeptide

SEQ ID NO: 1292 - protein, 107 aa, Artificial Sequence; identical to SEQ ID NO: 1152
  Description of Artificial Sequence: Synthetic polypeptide

SEQ ID NO: 1293 - DNA, 1458 bp, Artificial Sequence
  Description of Artificial Sequence: Synthetic polynucleotide
atggccctccctgtcaccgccctgctgcttccgctggctcttctgctccacgccgctcggcccgacgtcgtgatgacccagtcaccggcattcctgtccgtgactcccggagaaaaggtcacgattacttgccgggcgtccaagagcatctccaaggacctcgcctggtaccaacagaagccggaccaggcccctaagctgttgatctactcggggtccacccttcaatcgggagtgccatcgcggtttagcggttcgggttctgggaccgacttcactttcaccatctcctcactggaagccgaggatgccgccacttactactgtcagcagcacaacaagtatccgtacaccttcggaggcggtaccaaagtggagatcaaggggggtggcggtagcggaggagggggctccggcggcggcggctcagggggcggaggaagcgaagtgcagctcgtcgagagcggagggggactggtgcagcccggaggaagcctgaggctgtcctgcgctgcctccggctacaccttcacctcctactggatgaactgggtcagacaggcacctggaaagggactggtctgggtgtcgcgcattgacccctacgactccgaaacccattacaatcagaaattcaaggaccgcttcaccatctccgtggacaaagccaagagcaccgcgtacctccaaatgaactccctgcgcgctgaggatacagcagtgtactattgcgcccggggaaactgggatgattactggggccagggaactactgtgactgtgtcatccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1294 - protein, 486 aa, Artificial Sequence
  Description of Artificial Sequence: Synthetic polypeptide
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1295 - protein, 263 aa, Artificial Sequence
  Description of Artificial Sequence: Synthetic polypeptide
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSS

SEQ ID NO: 1296 - protein, 115 aa, Artificial Sequence; identical to SEQ ID NO: 1266
  Description of Artificial Sequence: Synthetic polypeptide

SEQ ID NO: 1297 - protein, 107 aa, Artificial Sequence; identical to SEQ ID NO: 1157
  Description of Artificial Sequence: Synthetic polypeptide

SEQ ID NO: 1298 - DNA, 1458 bp, Artificial Sequence
  Description of Artificial Sequence: Synthetic polynucleotide
atggccctccctgtcaccgccctgctgcttccgctggctcttctgctccacgccgctcggcccgacgtggtcatgactcagtccccggactcactcgcggtgtcgcttggagagagagcgaccatcaactgtcgggcctcaaagagcatcagcaaggacctggcctggtaccagcagaagccgggacagccgccaaagctgctgatctactccgggtccaccttgcaatctggtgtccctgaccggttctccggttccgggtcgggtaccgacttcacgctcactatttcgtcgctgcaagccgaagatgtggccgtgtactattgccaacagcacaacaagtacccctacacttttggcggaggcaccaaggtggaaatcaaggggggtggcggtagcggaggagggggctccggcggcggcggctcagggggcggaggaagcgaagtgcagctcgtcgagagcggagggggactggtgcagcccggaggaagcctgaggctgtcctgcgctgcctccggctacaccttcacctcctactggatgaactgggtcagacaggcacctggaaagggactggtctgggtgtcgcgcattgacccctacgactccgaaacccattacaatcagaaattcaaggaccgcttcaccatctccgtggacaaagccaagagcaccgcgtacctccaaatgaactccctgcgcgctgaggatacagcagtgtactattgcgcccggggaaactgggatgattactggggccagggaactactgtgactgtgtcatccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1299 - protein, 486 aa, Artificial Sequence
  Description of Artificial Sequence: Synthetic polypeptide
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1300 - protein, 263 aa, Artificial Sequence
  Description of Artificial Sequence: Synthetic polypeptide
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSS

SEQ ID NO: 1301 - protein, 115 aa, Artificial Sequence; identical to SEQ ID NO: 1266
  Description of Artificial Sequence: Synthetic polypeptide

SEQ ID NO: 1302 - protein, 107 aa, Artificial Sequence; identical to SEQ ID NO: 1162
  Description of Artificial Sequence: Synthetic polypeptide

SEQ ID NO: 1303 - protein, 514 aa, Artificial Sequence
  Description of Artificial Sequence: Synthetic polypeptide
EVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARDLGWIAVAGTFDYWGQGTLVTVSSGGGGSGGGGSGGGGSQSALTQPASVSGSPGQSITISCTGTSSDVGGYNYVSWYQQHPGKAPKLMIYDVSKRPSGVSNRFSGSKSGNTASLTISGLQAEDEADYYCSSYTSSSLNHVFGTGTKVTVLTGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSS

SEQ ID NO: 1304 - protein, 737 aa, Artificial Sequence
  Description of Artificial Sequence: Synthetic polypeptide
EVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARDLGWIAVAGTFDYWGQGTLVTVSSGGGGSGGGGSGGGGSQSALTQPASVSGSPGQSITISCTGTSSDVGGYNYVSWYQQHPGKAPKLMIYDVSKRPSGVSNRFSGSKSGNTASLTISGLQAEDEADYYCSSYTSSSLNHVFGTGTKVTVLTGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1305 - DNA, 1542 bp, Artificial Sequence
  Description of Artificial Sequence: Synthetic polynucleotide
gaagtgcagctccaacagtcaggaccaggactcgtcaaaccctcccaaaccctcagccttacttgtgccatttccggggattccgtgtcgagcaattccgccgcctggaactggatcaggcagtccccgtcgcgcgggctcgaatggctgggacgcacttactaccggtccaagtggtacaacgactacgccgtcagcgtgaagtcgcggatcaccattaaccccgacacctccaagaaccagttcagcctccaactgaactccgtgacccctgaggataccgcggtctactattgtgcccgggacctgggttggattgccgtggccgggaccttcgattactggggccagggaactctcgtcaccgtgtcctcgggagggggtggctcagggggtggtggatcgggtggtggcggctcccagtccgctctgactcagcccgcgtccgtgtccggttccccgggacagtcgatcacaatcagctgcactggcacctcctccgacgtcggcgggtacaactacgtgtcgtggtaccaacagcaccctggaaaagccccgaagctgatgatctacgacgtgtccaagaggccaagcggagtgtcaaatcgcttttccggctcgaagtcgggaaacaccgccagcctgactatctcgggactgcaggccgaggacgaggccgactactactgctcgtcttacacctcctcatccttgaaccacgtgttcggaaccggaaccaaggtcaccgtgctgactggagggggaggctccggtggcggcggctctggaggaggagggtccggcggaggaggatcggaaatcgtgatgacccagtcccccgcaaccctgtccctgagcccgggcgaaagagctaccctgtcgtgccgggcgtcgcaggacatctccaagtacctgaactggtaccagcagaagcccggccaggcaccgagactgctgatctaccacactagccgcctgcattccggtatccccgcacggttcagcggcagcgggagcggaaccgattacacgctcactatttcctcactgcaacccgaggatttcgctgtgtacttctgccaacaaggaaacaccctgccttataccttcggacagggtacaaagctggagattaagggaggagggggctccggcggcgggggcagcgggggcggcggaagccaggtccagctgcaggaatccggtccgggactcgtgaagccctccgaaactctctcccttacgtgcaccgtgtcaggggtgtccctgccggactacggagtgtcctggattcggcaacctccggggaagggactggagtggatcggagtgatctggggctccgaaactacctactaccagtcatcattgaagtcaagagtgaccatttcgaaggacaacagcaagaaccaggtgtcccttaaactgtccagcgtgaccgcggcggatactgccgtctactactgcgccaagcactattactacggcggaagctatgcgatggactactggggacagggcaccttggtcactgtgtcctcc

SEQ ID NO: 1306 - DNA, 2211 bp, Artificial Sequence
  Description of Artificial Sequence: Synthetic polynucleotide
gaagtgcagctccaacagtcaggaccaggactcgtcaaaccctcccaaaccctcagccttacttgtgccatttccggggattccgtgtcgagcaattccgccgcctggaactggatcaggcagtccccgtcgcgcgggctcgaatggctgggacgcacttactaccggtccaagtggtacaacgactacgccgtcagcgtgaagtcgcggatcaccattaaccccgacacctccaagaaccagttcagcctccaactgaactccgtgacccctgaggataccgcggtctactattgtgcccgggacctgggttggattgccgtggccgggaccttcgattactggggccagggaactctcgtcaccgtgtcctcgggagggggtggctcagggggtggtggatcgggtggtggcggctcccagtccgctctgactcagcccgcgtccgtgtccggttccccgggacagtcgatcacaatcagctgcactggcacctcctccgacgtcggcgggtacaactacgtgtcgtggtaccaacagcaccctggaaaagccccgaagctgatgatctacgacgtgtccaagaggccaagcggagtgtcaaatcgcttttccggctcgaagtcgggaaacaccgccagcctgactatctcgggactgcaggccgaggacgaggccgactactactgctcgtcttacacctcctcatccttgaaccacgtgttcggaaccggaaccaaggtcaccgtgctgactggagggggaggctccggtggcggcggctctggaggaggagggtccggcggaggaggatcggaaatcgtgatgacccagtcccccgcaaccctgtccctgagcccgggcgaaagagctaccctgtcgtgccgggcgtcgcaggacatctccaagtacctgaactggtaccagcagaagcccggccaggcaccgagactgctgatctaccacactagccgcctgcattccggtatccccgcacggttcagcggcagcgggagcggaaccgattacacgctcactatttcctcactgcaacccgaggatttcgctgtgtacttctgccaacaaggaaacaccctgccttataccttcggacagggtacaaagctggagattaagggaggagggggctccggcggcgggggcagcgggggcggcggaagccaggtccagctgcaggaatccggtccgggactcgtgaagccctccgaaactctctcccttacgtgcaccgtgtcaggggtgtccctgccggactacggagtgtcctggattcggcaacctccggggaagggactggagtggatcggagtgatctggggctccgaaactacctactaccagtcatcattgaagtcaagagtgaccatttcgaaggacaacagcaagaaccaggtgtcccttaaactgtccagcgtgaccgcggcggatactgccgtctactactgcgccaagcactattactacggcggaagctatgcgatggactactggggacagggcaccttggtcactgtgtcctccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1307 - protein, 514 aa, Artificial Sequence
  Description of Artificial Sequence: Synthetic polypeptide
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSGGGGSEVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARDLGWIAVAGTFDYWGQGTLVTVSSGGGGSGGGGSGGGGSQSALTQPASVSGSPGQSITISCTGTSSDVGGYNYVSWYQQHPGKAPKLMIYDVSKRPSGVSNRFSGSKSGNTASLTISGLQAEDEADYYCSSYTSSSLNHVFGTGTKVTVLT

SEQ ID NO: 1308 - protein, 737 aa, Artificial Sequence
  Description of Artificial Sequence: Synthetic polypeptide
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSGGGGSEVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARDLGWIAVAGTFDYWGQGTLVTVSSGGGGSGGGGSGGGGSQSALTQPASVSGSPGQSITISCTGTSSDVGGYNYVSWYQQHPGKAPKLMIYDVSKRPSGVSNRFSGSKSGNTASLTISGLQAEDEADYYCSSYTSSSLNHVFGTGTKVTVLTTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1309 - DNA, 1542 bp, Artificial Sequence
  Description of Artificial Sequence: Synthetic polynucleotide
gaaatcgtgatgacccagtcccccgcaaccctgtccctgagcccgggcgaaagagctaccctgtcgtgccgggcgtcgcaggacatctccaagtacctgaactggtaccagcagaagcccggccaggcaccgagactgctgatctaccacactagccgcctgcattccggtatccccgcacggttcagcggcagcgggagcggaaccgattacacgctcactatttcctcactgcaacccgaggatttcgctgtgtacttctgccaacaaggaaacaccctgccttataccttcggacagggtacaaagctggagattaagggaggagggggctccggcggcgggggcagcgggggcggcggaagccaggtccagctgcaggaatccggtccgggactcgtgaagccctccgaaactctctcccttacgtgcaccgtgtcaggggtgtccctgccggactacggagtgtcctggattcggcaacctccggggaagggactggagtggatcggagtgatctggggctccgaaactacctactaccagtcatcattgaagtcaagagtgaccatttcgaaggacaacagcaagaaccaggtgtcccttaaactgtccagcgtgaccgcggcggatactgccgtctactactgcgccaagcactattactacggcggaagctatgcgatggactactggggacagggcaccttggtcactgtgtcctccggagggggaggctccggtggcggcggctctggaggaggagggtccggcggaggaggatcggaagtgcagctccaacagtcaggaccaggactcgtcaaaccctcccaaaccctcagccttacttgtgccatttccggggattccgtgtcgagcaattccgccgcctggaactggatcaggcagtccccgtcgcgcgggctcgaatggctgggacgcacttactaccggtccaagtggtacaacgactacgccgtcagcgtgaagtcgcggatcaccattaaccccgacacctccaagaaccagttcagcctccaactgaactccgtgacccctgaggataccgcggtctactattgtgcccgggacctgggttggattgccgtggccgggaccttcgattactggggccagggaactctcgtcaccgtgtcctcgggagggggtggctcagggggtggtggatcgggtggtggcggctcccagtccgctctgactcagcccgcgtccgtgtccggttccccgggacagtcgatcacaatcagctgcactggcacctcctccgacgtcggcgggtacaactacgtgtcgtggtaccaacagcaccctggaaaagccccgaagctgatgatctacgacgtgtccaagaggccaagcggagtgtcaaatcgcttttccggctcgaagtcgggaaacaccgccagcctgactatctcgggactgcaggccgaggacgaggccgactactactgctcgtcttacacctcctcatccttgaaccacgtgttcggaaccggaaccaaggtcaccgtgctgact

SEQ ID NO: 1310 - DNA, 2211 bp, Artificial Sequence
  Description of Artificial Sequence: Synthetic polynucleotide
gaaatcgtgatgacccagtcccccgcaaccctgtccctgagcccgggcgaaagagctaccctgtcgtgccgggcgtcgcaggacatctccaagtacctgaactggtaccagcagaagcccggccaggcaccgagactgctgatctaccacactagccgcctgcattccggtatccccgcacggttcagcggcagcgggagcggaaccgattacacgctcactatttcctcactgcaacccgaggatttcgctgtgtacttctgccaacaaggaaacaccctgccttataccttcggacagggtacaaagctggagattaagggaggagggggctccggcggcgggggcagcgggggcggcggaagccaggtccagctgcaggaatccggtccgggactcgtgaagccctccgaaactctctcccttacgtgcaccgtgtcaggggtgtccctgccggactacggagtgtcctggattcggcaacctccggggaagggactggagtggatcggagtgatctggggctccgaaactacctactaccagtcatcattgaagtcaagagtgaccatttcgaaggacaacagcaagaaccaggtgtcccttaaactgtccagcgtgaccgcggcggatactgccgtctactactgcgccaagcactattactacggcggaagctatgcgatggactactggggacagggcaccttggtcactgtgtcctccggagggggaggctccggtggcggcggctctggaggaggagggtccggcggaggaggatcggaagtgcagctccaacagtcaggaccaggactcgtcaaaccctcccaaaccctcagccttacttgtgccatttccggggattccgtgtcgagcaattccgccgcctggaactggatcaggcagtccccgtcgcgcgggctcgaatggctgggacgcacttactaccggtccaagtggtacaacgactacgccgtcagcgtgaagtcgcggatcaccattaaccccgacacctccaagaaccagttcagcctccaactgaactccgtgacccctgaggataccgcggtctactattgtgcccgggacctgggttggattgccgtggccgggaccttcgattactggggccagggaactctcgtcaccgtgtcctcgggagggggtggctcagggggtggtggatcgggtggtggcggctcccagtccgctctgactcagcccgcgtccgtgtccggttccccgggacagtcgatcacaatcagctgcactggcacctcctccgacgtcggcgggtacaactacgtgtcgtggtaccaacagcaccctggaaaagccccgaagctgatgatctacgacgtgtccaagaggccaagcggagtgtcaaatcgcttttccggctcgaagtcgggaaacaccgccagcctgactatctcgggactgcaggccgaggacgaggccgactactactgctcgtcttacacctcctcatccttgaaccacgtgttcggaaccggaaccaaggtcaccgtgctgactaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1311 - protein, 20 aa, Artificial Sequence
  Description of Artificial Sequence: Synthetic peptide
GGGGSGGGGSGGGGSGGGGS

SEQ ID NO: 1312 - DNA, 5 bp, Artificial Sequence
  Description of Artificial Sequence: Synthetic oligonucleotide
ggaaa

SEQ ID NO: 1313 - DNA, 9 bp, Artificial Sequence
  Description of Artificial Sequence: Synthetic oligonucleotide
  modified_base (7)..(7): a, c, t, g, unknown or other
  modified_base (9)..(9): a, c, t, g, unknown or other
wggaaanhn

SEQ ID NO: 1314 - DNA, 6 bp, Artificial Sequence
  Description of Artificial Sequence: Synthetic oligonucleotide
gggact

SEQ ID NO: 1315 - DNA, 120 bp, Artificial Sequence
  Description of Artificial Sequence: Synthetic polynucleotide
agcttggatccaagaggaaaatttgtttcatacagaaggcgttaagaggaaaatttgtttcatacagaaggcgttaagaggaaaatttgtttcatacagaaggcgttcaagcttgtcgac

SEQ ID NO: 1316 - protein, 4 aa, Artificial Sequence
  Description of Artificial Sequence: Synthetic peptide
RGDS

SEQ ID NO: 1317 - protein, 41 aa, Artificial Sequence
  Description of Artificial Sequence: Synthetic polypeptide
RSKRSRLLHSDYMNMTPRRPGPTRKHYQPYAPPRDFAAYRS

SEQ ID NO: 1318 - DNA, 123 bp, Artificial Sequence; identical to SEQ ID NO: 52
  Description of Artificial Sequence: Synthetic polynucleotide

SEQ ID NO: 1319 - protein, 35 aa, Artificial Sequence
  Description of Artificial Sequence: Synthetic polypeptide
TKKKYSSSVHDPNGEYMFMRAVNTAKKSRLTDVTL

SEQ ID NO: 1320 - DNA, 105 bp, Artificial Sequence
  Description of Artificial Sequence: Synthetic polynucleotide
acaaaaaagaagtattcatccagtgtgcacgaccctaacggtgaatacatgttcatgagagcagtgaacacagccaaaaaatccagactcacagatgtgacccta

SEQ ID NO: 1321 - protein, 35 aa, Artificial Sequence
  Description of Artificial Sequence: Synthetic polypeptide
TKKKYSSSVHDPNGEFMFMRAVNTAKKSRLTDVTL

SEQ ID NO: 1322 - protein, 18 aa, Artificial Sequence
  Description of Artificial Sequence: Synthetic peptide
GSTSGSGKPGSGEGSTKG

SEQ ID NO: 1323 - DNA, 521 bp, Artificial Sequence
  Description of Artificial Sequence: Synthetic polynucleotide
acccctctctccagccactaagccagttgctccctcggctgacggctgcacgcgaggcctccgaacgtcttacgccttgtggcgcgcccgtccttgtcccgggtgtgatggcggggtgtggggcggagggcgtggcggggaagggccggcgacgagagccgcgcgggacgactcgtcggcgataaccggtgtcgggtagcgccagccgcgcgacggtaacgagggaccgcgacaggcagacgctcccatgatcactctgcacgccgaaggcaaatagtgcaggccgtgcggcgcttggcgttccttggaagggctgaatccccgcctcgtccttcgcagcggccccccgggtgttcccatcgccgcttctaggcccactgcgacgcttgcctgcacttcttacacgctctgggtcccagccgcggcgacgcaaagggccttggtgcgggtctcgtcggcgcagggacgcgtttgggtcccgacggaaccttttccgcgttggggttggggcaccataagct

SEQ ID NO: 1324 - DNA, 118 bp, Artificial Sequence
  Description of Artificial Sequence: Synthetic polynucleotide
acccctctctccagccactaagccagttgctccctcggctgacggctgcacgcgaggcctccgaacgtcttacgccttgtggcgcgcccgtccttgtcccgggtgtgatggcggggtg

SEQ ID NO: 1325 - DNA, 221 bp, Artificial Sequence
  Description of Artificial Sequence: Synthetic polynucleotide
acccctctctccagccactaagccagttgctccctcggctgacggctgcacgcgaggcctccgaacgtcttacgccttgtggcgcgcccgtccttgtcccgggtgtgatggcggggtgtggggcggagggcgtggcggggaagggccggcgacgagagccgcgcgggacgactcgtcggcgataaccggtgtcgggtagcgccagccgcgcgacggtaacg

SEQ ID NO: 1326 - DNA, 324 bp, Artificial Sequence
  Description of Artificial Sequence: Synthetic polynucleotide
acccctctctccagccactaagccagttgctccctcggctgacggctgcacgcgaggcctccgaacgtcttacgccttgtggcgcgcccgtccttgtcccgggtgtgatggcggggtgtggggcggagggcgtggcggggaagggccggcgacgagagccgcgcgggacgactcgtcggcgataaccggtgtcgggtagcgccagccgcgcgacggtaacgagggaccgcgacaggcagacgctcccatgatcactctgcacgccgaaggcaaatagtgcaggccgtgcggcgcttggcgttccttggaagggctgaatccccg

SEQ ID NO: 1327 - DNA, 422 bp, Artificial Sequence
  Description of Artificial Sequence: Synthetic polynucleotide
acccctctctccagccactaagccagttgctccctcggctgacggctgcacgcgaggcctccgaacgtcttacgccttgtggcgcgcccgtccttgtcccgggtgtgatggcggggtgtggggcggagggcgtggcggggaagggccggcgacgagagccgcgcgggacgactcgtcggcgataaccggtgtcgggtagcgccagccgcgcgacggtaacgagggaccgcgacaggcagacgctcccatgatcactctgcacgccgaaggcaaatagtgcaggccgtgcggcgcttggcgttccttggaagggctgaatccccgcctcgtccttcgcagcggccccccgggtgttcccatcgccgcttctaggcccactgcgacgcttgcctgcacttcttacacgctctgggtcccagccg

SEQ ID NO: 1328 - protein, 21 aa, Artificial Sequence
  Description of Artificial Sequence: Synthetic peptide
  MISC_FEATURE (1)..(3): May or may not be present
GSGEGRGSLLTCGDVEENPGP

SEQ ID NO: 1329 - protein, 22 aa, Artificial Sequence
  Description of Artificial Sequence: Synthetic peptide
  MISC_FEATURE (1)..(3): May or may not be present
GSGATNFSLLKQAGDVEENPGP

SEQ ID NO: 1330 - protein, 23 aa, Artificial Sequence
  Description of Artificial Sequence: Synthetic peptide
  MISC_FEATURE (1)..(3): May or may not be present
GSGQCTNYALLKLAGDVESNPGP

SEQ ID NO: 1331 - protein, 25 aa, Artificial Sequence
  Description of Artificial Sequence: Synthetic peptide
  MISC_FEATURE (1)..(3): May or may not be present
GSGVKQTLNFDLLKLAGDVESNPGP

SEQ ID NO: 1332 - protein, 1132 aa, Homo sapiens [sequence omitted]

SEQ ID NO: 1333 - DNA, 4027 bp, Homo sapiens
caggcagcgtggtcctgctgcgcacgtgggaagccctggccccggccacccccgcgatgccgcgcgctccccgctgccgagccgtgcgctccctgctgcgcagccactaccgcgaggtgctgccgctggccacgttcgtgcggcgcctggggccccagggctggcggctggtgcagcgcggggacccggcggctttccgcgcgctggtggcccagtgcctggtgtgcgtgccctgggacgcacggccgccccccgccgccccctccttccgccaggtgtcctgcctgaaggagctggtggcccgagtgctgcagaggctgtgcgagcgcggcgcgaagaacgtgctggccttcggcttcgcgctgctggacggggcccgcgggggcccccccgaggccttcaccaccagcgtgcgcagctacctgcccaacacggtgaccgacgcactgcgggggagcggggcgtgggggctgctgttgcgccgcgtgggcgacgacgtgctggttcacctgctggcacgctgcgcgctctttgtgctggtggctcccagctgcgcctaccaggtgtgcgggccgccgctgtaccagctcggcgctgccactcaggcccggcccccgccacacgctagtggaccccgaaggcgtctgggatgcgaacgggcctggaaccatagcgtcagggaggccggggtccccctgggcctgccagccccgggtgcgaggaggcgcgggggcagtgccagccgaagtctgccgttgcccaagaggcccaggcgtggcgctgcccctgagccggagcggacgcccgttgggcaggggtcctgggcccacccgggcaggacgcgtggaccgagtgaccgtggtttctgtgtggtgtcacctgccagacccgccgaagaagccacctctttggagggtgcgctctctggcacgcgccactcccacccatccgtgggccgccagcaccacgcgggccccccatccacatcgcggccaccacgtccctgggacacgccttgtcccccggtgtacgccgagaccaagcacttcctctactcctcaggcgacaaggagcagctgcggccctccttcctactcagctctctgaggcccagcctgactggcgctcggaggctcgtggagaccatctttctgggttccaggccctggatgccagggactccccgcaggttgccccgcctgccccagcgctactggcaaatgcggcccctgtttctggagctgcttgggaaccacgcgcagtgcccctacggggtgctcctcaagacgcactgcccgctgcgagctgcggtcaccccagcagccggtgtctgtgcccgggagaagccccagggctctgtggcggcccccgaggaggaggacacagacccccgtcgcctggtgcagctgctccgccagcacagcagcccctggcaggtgtacggcttcgtgcgggcctgcctgcgccggctggtgcccccaggcctctggggctccaggcacaacgaacgccgcttcctcaggaacaccaagaagttcatctccctggggaagcatgccaagctctcgctgcaggagctgacgtggaagatgagcgtgcggggctgcgcttggctgcgcaggagcccaggggttggctgtgttccggccgcagagcaccgtctgcgtgaggagatcctggccaagttcctgcactggctgatgagtgtgtacgtcgtcgagctgctcaggtctttcttttatgtcacggagaccacgtttcaaaagaacaggctctttttctaccggaagagtgtctggagcaagttgcaaagcattggaatcagacagcacttgaagagggtgcagctgcgggagctgtcggaagcagaggtcaggcagcatcgggaagccaggcccgccctgctgacgtccagactccgcttcatccccaagcctgacgggctgcggccgattgtgaacatggactacgtcgtgggagccagaacgttccgcagagaaaagagggccgagcgtctcacctcgagggtgaaggcactgttcagcgtgctcaactacgagcgggcgcggcgccccggcctcctgggcgcctctgtgctgggcctggacgatatccacagggcctggcgcaccttcgtgctgcgtgtgcgggcccaggacccgccgcctgagctgtactttgtcaaggtggatgtgacgggcgcgtacgacaccatcccccaggacaggctcacggaggtcatcgccagcatcatcaaaccccagaacacgtactgcgtgcgtcggtatgccgtggtccagaaggccgcccatgggcacgtccgcaaggccttcaagagccacgtctctaccttgacagacctccagccgtacatgcgacagttcgtggctcacctgcaggagaccagcccgctgagggatgccgtcgtcatcgagcagagctcctccctgaatgaggccagcagtggcctcttcgacgtcttcctacgcttcatgtgccaccacgccgtgcgcatcaggggcaagtcctacgtccagtgccaggggatcccgcagggctccatcctctccacgctgctctgcagcctgtgctacggcgacatggagaacaagctgtttgcggggattcggcgggacgggctgctcctgcgtttggtggatgatttcttgttggtgacacctcacctcacccacgcgaaaaccttcctcaggaccctggtccgaggtgtccctgagtatggctgcgtggtgaacttgcggaagacagtggtgaacttccctgtagaagacgaggccctgggtggcacggcttttgttcagatgccggcccacggcctattcccctggtgcggcctgctgctggatacccggaccctggaggtgcagagcgactactccagctatgcccggacctccatcagagccagtctcaccttcaaccgcggcttcaaggctgggaggaacatgcgtcgcaaactctttggggtcttgcggctgaagtgtcacagcctgtttctggatttgcaggtgaacagcctccagacggtgtgcaccaacatctacaagatcctcctgctgcaggcgtacaggtttcacgcatgtgtgctgcagctcccatttcatcagcaagtttggaagaaccccacatttttcctgcgcgtcatctctgacacggcctccctctgctactccatcctgaaagccaagaacgcagggatgtcgctgggggccaagggcgccgccggccctctgccctccgaggccgtgcagtggctgtgccaccaagcattcctgctcaagctgactcgacaccgtgtcacctacgtgccactcctggggtcactcaggacagcccagacgcagctgagtcggaagctcccggggacgacgctgactgccctggaggccgcagccaacccggcactgccctcagacttcaagaccatcctggactgatggccacccgcccacagccaggccgagagcagacaccagcagccctgtcacgccgggctctacgtcccagggagggaggggcggcccacacccaggcccgcaccgctgggagtctgaggcctgagtgagtgtttggccgaggcctgcatgtccggctgaaggctgagtgtccggctgaggcctgagcgagtgtccagccaagggctgagtgtccagcacacctgccgtcttcacttccccacaggctggcgctcggctccaccccagggccagcttttcctcaccaggagcccggcttccactccccacataggaatagtccatccccagattcgccattgttcacccctcgccctgccctcctttgccttccacccccaccatccaggtggagaccctgagaaggaccctgggagctctgggaatttggagtgaccaaaggtgtgccctgtacacaggcgaggaccctgcacctggatgggggtccctgtgggtcaaattggggggaggtgctgtgggagtaaaatactgaatatatgagtttttcagttttgaaaaaaaaaaaaaaaaaa

SEQ ID NO: 1334 - protein, 14 aa, Artificial Sequence
  Description of Artificial Sequence: Synthetic peptide
  MOD_RES (3)..(5): Any amino acid
  MOD_RES (7)..(7): Any amino acid
  MOD_RES (9)..(12): Any amino acid
TGXXXDXGXXXXVS

SEQ ID NO: 1335 - protein, 7 aa, Artificial Sequence
  Description of Artificial Sequence: Synthetic peptide
  MOD_RES (1)..(1): Any amino acid
  MOD_RES (3)..(3): Any amino acid
XVXNRPS

SEQ ID NO: 1336 - protein, 11 aa, Artificial Sequence
  Description of Artificial Sequence: Synthetic peptide
  MOD_RES (3)..(11): Any amino acid
SSXXXXXXXXX

SEQ ID NO: 1337 - protein, 7 aa, Artificial Sequence
  Description of Artificial Sequence: Synthetic peptide
NNNAAWN

SEQ ID NO: 1338 - protein, 7 aa, Artificial Sequence
  Description of Artificial Sequence: Synthetic peptide
SNSAAWN

SEQ ID NO: 1339 - protein, 7 aa, Artificial Sequence
  Description of Artificial Sequence: Synthetic peptide
SNSDTWN

SEQ ID NO: 1340 - protein, 7 aa, Artificial Sequence
  Description of Artificial Sequence: Synthetic peptide
SNSDTWN

SEQ ID NO: 1341 - protein, 7 aa, Artificial Sequence
  Description of Artificial Sequence: Synthetic peptide
SNSDTWN

SEQ ID NO: 1342 - protein, 7 aa, Artificial Sequence
  Description of Artificial Sequence: Synthetic peptide
SNSDTWN

SEQ ID NO: 1343 - protein, 7 aa, Artificial Sequence
  Description of Artificial Sequence: Synthetic peptide
SNSDTWN

SEQ ID NO: 1344 - protein, 7 aa, Artificial Sequence
  Description of Artificial Sequence: Synthetic peptide
SNSDTWN

SEQ ID NO: 1345 - protein, 7 aa, Artificial Sequence
  Description of Artificial Sequence: Synthetic peptide
SNSDTWN

SEQ ID NO: 1346 - protein, 18 aa, Artificial Sequence
  Description of Artificial Sequence: Synthetic peptide
RTYHRSTWYNDYVGSVKS

SEQ ID NO: 1347 - protein, 18 aa, Artificial Sequence
  Description of Artificial Sequence: Synthetic peptide
RTFYRSKWYNDYAVSVKG

SEQ ID NO: 1348 - protein, 18 aa, Artificial Sequence
  Description of Artificial Sequence: Synthetic peptide
RTYHRSTWYDDYASSVRG

SEQ ID NO: 1349 - protein, 18 aa, Artificial Sequence
  Description of Artificial Sequence: Synthetic peptide
RTYHRSTWYDDYASSVRG

SEQ ID NO: 1350 - protein, 18 aa, Artificial Sequence
  Description of Artificial Sequence: Synthetic peptide
RTYHRSTWYDDYASSVRG

SEQ ID NO: 1351 - protein, 18 aa, Artificial Sequence
  Description of Artificial Sequence: Synthetic peptide
RTYHRSTWYDDYASSVRG

SEQ ID NO: 1352 - protein, 18 aa, Artificial Sequence
  Description of Artificial Sequence: Synthetic peptide
RTYHRSTWYDDYASSVRG

SEQ ID NO: 1353 - protein, 18 aa, Artificial Sequence
  Description of Artificial Sequence: Synthetic peptide
RTYHRSTWYDDYASSVRG

SEQ ID NO: 1354 - protein, 18 aa, Artificial Sequence
  Description of Artificial Sequence: Synthetic peptide
RTYHRSTWYDDYASSVRG

SEQ ID NO: 1355 - protein, 12 aa, Artificial Sequence
  Description of Artificial Sequence: Synthetic peptide
ETDYGDYGAFDI

SEQ ID NO: 1356 - protein, 9 aa, Artificial Sequence
  Description of Artificial Sequence: Synthetic peptide
GDYYYGLDV

SEQ ID NO: 1357 - protein, 15 aa, Artificial Sequence
  Description of Artificial Sequence: Synthetic peptide
DRLQDGNSWSDAFDV

SEQ ID NO: 1358 - protein, 15 aa, Artificial Sequence
  Description of Artificial Sequence: Synthetic peptide
DRLQDGNSWSDAFDV

SEQ ID NO: 1359 - protein, 15 aa, Artificial Sequence
  Description of Artificial Sequence: Synthetic peptide
DRLQDGNSWSDAFDV

SEQ ID NO: 1360 - protein, 15 aa, Artificial Sequence
  Description of Artificial Sequence: Synthetic peptide
DRLQDGNSWSDAFDV

SEQ ID NO: 1361 - protein, 15 aa, Artificial Sequence
  Description of Artificial Sequence: Synthetic peptide
DRLQDGNSWSDAFDV

SEQ ID NO: 1362 - protein, 15 aa, Artificial Sequence
  Description of Artificial Sequence: Synthetic peptide
VRLQDGNSWSDAFDV

SEQ ID NO: 1363 - protein, 15 aa, Artificial Sequence
  Description of Artificial Sequence: Synthetic peptide
VRLQDGNSWSDAFDV

SEQ ID NO: 1364 - protein, 7 aa, Artificial Sequence
  Description of Artificial Sequence: Synthetic peptide
SNSAAWN

SEQ ID NO: 1365 - protein, 5 aa, Artificial Sequence
  Description of Artificial Sequence: Synthetic peptide
SNYMS

SEQ ID NO: 1366 - protein, 7 aa, Artificial Sequence
  Description of Artificial Sequence: Synthetic peptide
SNSAAWN

SEQ ID NO: 1367 - protein, 7 aa, Artificial Sequence
  Description of Artificial Sequence: Synthetic peptide
SNSDTWN

SEQ ID NO: 1368 - protein, 5 aa, Artificial Sequence
  Description of Artificial Sequence: Synthetic peptide
DYAMH

SEQ ID NO: 1369 - protein, 5 aa, Artificial Sequence
  Description of Artificial Sequence: Synthetic peptide
DYAMH

SEQ ID NO: 1370 - protein, 7 aa, Artificial Sequence
  Description of Artificial Sequence: Synthetic peptide
SNSATWT

SEQ ID NO: 1371 - protein, 5 aa, Artificial Sequence
  Description of Artificial Sequence: Synthetic peptide
GYYMH

SEQ ID NO: 1372 - protein, 5 aa, Artificial Sequence
  Description of Artificial Sequence: Synthetic peptide
SYGIS

SEQ ID NO: 1373 - protein, 5 aa, Artificial Sequence
  Description of Artificial Sequence: Synthetic peptide
NAWMN

SEQ ID NO: 1374 - protein, 7 aa, Artificial Sequence
  Description of Artificial Sequence: Synthetic peptide
SNSDTWN

SEQ ID NO: 1375 - protein, 7 aa, Artificial Sequence
  Description of Artificial Sequence: Synthetic peptide
SNSAAWN

SEQ ID NO: 1376 - protein, 7 aa, Artificial Sequence
  Description of Artificial Sequence: Synthetic peptide
SNSDTWN

SEQ ID NO: 1377 - protein, 7 aa, Artificial Sequence
  Description of Artificial Sequence: Synthetic peptide
SSSYYWG

SEQ ID NO: 1378 - protein, 5 aa, Artificial Sequence
  Description of Artificial Sequence: Synthetic peptide
SYYMH

SEQ ID NO: 1379 - protein, 5 aa, Artificial Sequence
  Description of Artificial Sequence: Synthetic peptide
SYAMH

SEQ ID NO: 1380 - protein, 5 aa, Artificial Sequence
  Description of Artificial Sequence: Synthetic peptide
SYYMH

SEQ ID NO: 1381 - protein, 5 aa, Artificial Sequence
  Description of Artificial Sequence: Synthetic peptide
SYAMS

SEQ ID NO: 1382 - protein, 5 aa, Artificial Sequence
  Description of Artificial Sequence: Synthetic peptide
SYYMH

SEQ ID NO: 1383 - protein, 5 aa, Artificial Sequence
  Description of Artificial Sequence: Synthetic peptide
SYYMH

SEQ ID NO: 1384 - protein, 5 aa, Artificial Sequence
  Description of Artificial Sequence: Synthetic peptide
SYYMH

SEQ ID NO: 1385 - protein, 5 aa, Artificial Sequence
  Description of Artificial Sequence: Synthetic peptide
SYYMH

SEQ ID NO: 1386 - protein, 5 aa, Artificial Sequence
  Description of Artificial Sequence: Synthetic peptide
SYAIS

SEQ ID NO: 1387 - protein, 5 aa, Artificial Sequence
  Description of Artificial Sequence: Synthetic peptide
SYYMH

SEQ ID NO: 1388 - protein, 5 aa, Artificial Sequence
  Description of Artificial Sequence: Synthetic peptide
SYAMS

SEQ ID NO: 1389 - protein, 5 aa, Artificial Sequence
  Description of Artificial Sequence: Synthetic peptide
SYYMH

SEQ ID NO: 1390 - protein, 5 aa, Artificial Sequence
  Description of Artificial Sequence: Synthetic peptide
GSWIG

SEQ ID NO: 1391 - protein, 5 aa, Artificial Sequence
  Description of Artificial Sequence: Synthetic peptide
SYYWS

SEQ ID NO: 1392 - protein, 5 aa, Artificial Sequence
  Description of Artificial Sequence: Synthetic peptide
DYYMS

SEQ ID NO: 1393 - protein, 5 aa, Artificial Sequence
  Description of Artificial Sequence: Synthetic peptide
SYYMH

SEQ ID NO: 1394 - protein, 5 aa, Artificial Sequence
  Description of Artificial Sequence: Synthetic peptide
GYYMH

SEQ ID NO: 1395 - protein, 5 aa, Artificial Sequence
  Description of Artificial Sequence: Synthetic peptide
SYDIN

SEQ ID NO: 1396 - protein, 5 aa, Artificial Sequence
  Description of Artificial Sequence: Synthetic peptide
SYGIS

SEQ ID NO: 1397 - protein, 7 aa, Artificial Sequence
  Description of Artificial Sequence: Synthetic peptide
TFGMSVS

SEQ ID NO: 1398 - protein, 7 aa, Artificial Sequence
  Description of Artificial Sequence: Synthetic peptide
TSRHWWN

SEQ ID NO: 1399 - protein, 5 aa, Artificial Sequence
  Description of Artificial Sequence: Synthetic peptide
SYYMH

SEQ ID NO: 1400 - protein, 5 aa, Artificial Sequence
  Description of Artificial Sequence: Synthetic peptide
SYYMH

SEQ ID NO: 1401 - protein, 5 aa, Artificial Sequence
  Description of Artificial Sequence: Synthetic peptide
SYYMH

SEQ ID NO: 1402 - protein, 5 aa, Artificial Sequence
  Description of Artificial Sequence: Synthetic peptide
SYYMH

SEQ ID NO: 1403 - protein, 18 aa, Artificial Sequence
  Description of Artificial Sequence: Synthetic peptide
RTYYRSKWYNDYAVSVKS

SEQ ID NO: 1404 - protein, 16 aa, Artificial Sequence
  Description of Artificial Sequence: Synthetic peptide
VIYSGGSTYYADSVKG

SEQ ID NO: 1405 - protein, 18 aa, Artificial Sequence
  Description of Artificial Sequence: Synthetic peptide
RTYYRSKWYNDYAVSVKS

SEQ ID NO: 1406 - protein, 18 aa, Artificial Sequence
  Description of Artificial Sequence: Synthetic peptide
RTYHRSTWYDDYASSVRG

SEQ ID NO: 1407 - protein, 17 aa, Artificial Sequence
  Description of Artificial Sequence: Synthetic peptide
GISWNSGSIGYADSVKG

SEQ ID NO: 1408 - protein, 17 aa, Artificial Sequence
  Description of Artificial Sequence: Synthetic peptide
GISWNSGSIGYADSVKG

SEQ ID NO: 1409 - protein, 18 aa, Artificial Sequence
  Description of Artificial Sequence: Synthetic peptide
RTYYRSTWYNDYAVSVKS

SEQ ID NO: 1410 - protein, 17 aa, Artificial Sequence
  Description of Artificial Sequence: Synthetic peptide
WINPNSGGTNYAQKFQG

SEQ ID NO: 1411 - protein, 17 aa, Artificial Sequence
  Description of Artificial Sequence: Synthetic peptide
WISAYNGNTNYAQKLQG

SEQ ID NO: 1412 - protein, 19 aa, Artificial Sequence
  Description of Artificial Sequence: Synthetic peptide
RIKSKTDGGTADYAAPVKG

SEQ ID NO: 1413 - protein, 18 aa, Artificial Sequence
  Description of Artificial Sequence: Synthetic peptide
RTYHRSTWYDDYASSVRG

SEQ ID NO: 1414 - protein, 18 aa, Artificial Sequence
  Description of Artificial Sequence: Synthetic peptide
RTYYRSKWYNDYAVSVKS

SEQ ID NO: 1415 - protein, 18 aa, Artificial Sequence
  Description of Artificial Sequence: Synthetic peptide
RTYHRSTWYDDYASSVRG

SEQ ID NO: 1416 - protein, 16 aa, Artificial Sequence
  Description of Artificial Sequence: Synthetic peptide
SIYYSGSTYYNPSLKS

SEQ ID NO: 1417 - protein, 17 aa, Artificial Sequence
  Description of Artificial Sequence: Synthetic peptide
IINPSGGSTSYAQKFQG

SEQ ID NO: 1418 - protein, 17 aa, Artificial Sequence
  Description of Artificial Sequence: Synthetic peptide
AISSNGGSTYYANSVKD

SEQ ID NO: 1419 - protein, 17 aa, Artificial Sequence
  Description of Artificial Sequence: Synthetic peptide
IINPSGGSTSYAQKFQG

SEQ ID NO: 1420 - protein, 17 aa, Artificial Sequence
  Description of Artificial Sequence: Synthetic peptide
AISGSGGSTYYADSVKG

SEQ ID NO: 1421 - protein, 17 aa, Artificial Sequence
  Description of Artificial Sequence: Synthetic peptide
IINPSGGSTSYAQKFQG

SEQ ID NO: 1422 - protein, 17 aa, Artificial Sequence
  Description of Artificial Sequence: Synthetic peptide
IINPSGGSTSYAQKFQG

SEQ ID NO: 1423 - protein, 17 aa, Artificial Sequence
  Description of Artificial Sequence: Synthetic peptide
IINPSGGSTSYAQKFQG

SEQ ID NO: 1424 - protein, 17 aa, Artificial Sequence
  Description of Artificial Sequence: Synthetic peptide
IINPSGGSTSYAQKFQG

SEQ ID NO: 1425 - protein, 17 aa, Artificial Sequence
  Description of Artificial Sequence: Synthetic peptide
GIIPIFGTANYAQKFQG

SEQ ID NO: 1426 - protein, 17 aa, Artificial Sequence
  Description of Artificial Sequence: Synthetic peptide
IINPSGGSTSYAQKFQG

SEQ ID NO: 1427 - protein, 17 aa, Artificial Sequence
  Description of Artificial Sequence: Synthetic peptide
YISSSSSTIYYADSVKG

SEQ ID NO: 1428 - protein, 17 aa, Artificial Sequence
  Description of Artificial Sequence: Synthetic peptide
IINPSGGSTSYAQKFQG

SEQ ID NO: 1429 - protein, 17 aa, Artificial Sequence
  Description of Artificial Sequence: Synthetic peptide
IIYPGDSDTRYSPSFQG

SEQ ID NO: 1430 - protein, 16 aa, Artificial Sequence
  Description of Artificial Sequence: Synthetic peptide
FTSHSGNVKYNPSLTG

SEQ ID NO: 1431 - protein, 17 aa, Artificial Sequence
  Description of Artificial Sequence: Synthetic peptide
YISSSGSTIYYADSVKG

SEQ ID NO: 1432 - protein, 17 aa, Artificial Sequence
  Description of Artificial Sequence: Synthetic peptide
IINPSGGSTSYAQKFQG

SEQ ID NO: 1433 - protein, 17 aa, Artificial Sequence
  Description of Artificial Sequence: Synthetic peptide
WINPNSGGTNYAQKFQG

SEQ ID NO: 1434 - protein, 17 aa, Artificial Sequence
  Description of Artificial Sequence: Synthetic peptide
WMNPNSGNTGYAQKFQG

SEQ ID NO: 1435 - protein, 17 aa, Artificial Sequence
  Description of Artificial Sequence: Synthetic peptide
WISAYNGNTNYAQKLQG

SEQ ID NO: 1436 - protein, 16 aa, Artificial Sequence
  Description of Artificial Sequence: Synthetic peptide
LIDWDDDKYYSTSLRT

SEQ ID NO: 1437 - protein, 16 aa, Artificial Sequence
  Description of Artificial Sequence: Synthetic peptide
QIYHSGTTTYNPSLGS

SEQ ID NO: 1438 - protein, 17 aa, Artificial Sequence
  Description of Artificial Sequence: Synthetic peptide
IINPSGGSTSYAQKFQG

SEQ ID NO: 1439 - protein, 17 aa, Artificial Sequence
  Description of Artificial Sequence: Synthetic peptide
IINPSGGSTSYAQKFQG

SEQ ID NO: 1440 - protein, 17 aa, Artificial Sequence
  Description of Artificial Sequence: Synthetic peptide
IINPSGGSTSYAQKFQG

SEQ ID NO: 1441 - protein, 17 aa, Artificial Sequence
  Description of Artificial Sequence: Synthetic peptide
IINPSGGSTSYAQKFQG

SEQ ID NO: 1442 - protein, 12 aa, Artificial Sequence
  Description of Artificial Sequence: Synthetic peptide
EVTGDLEDAFDI

SEQ ID NO: 1443 - protein, 18 aa, Artificial Sequence
  Description of Artificial Sequence: Synthetic peptide
QSTPYDSSGYYSGDAFDI

SEQ ID NO: 1444 - protein, 13 aa, Artificial Sequence
  Description of Artificial Sequence: Synthetic peptide
DLGWIAVAGTFDY

SEQ ID NO: 1445 - protein, 15 aa, Artificial Sequence
  Description of Artificial Sequence: Synthetic peptide
DRLQDGNSWSDAFDV

SEQ ID NO: 1446 - protein, 13 aa, Artificial Sequence
  Description of Artificial Sequence: Synthetic peptide
GLSSWHFHDALDI

SEQ ID NO: 1447 - protein, 15 aa, Artificial Sequence
  Description of Artificial Sequence: Synthetic peptide
DKGGGYYDFWSGSDY

SEQ ID NO: 1448 - protein, 9 aa, Artificial Sequence
  Description of Artificial Sequence: Synthetic peptide
EGSGSYYAY

SEQ ID NO: 1449 - protein, 13 aa, Artificial Sequence
  Description of Artificial Sequence: Synthetic peptide
DYWGYYGSGTLDY

SEQ ID NO: 1450 - protein, 19 aa, Artificial Sequence
  Description of Artificial Sequence: Synthetic peptide
AGLALYSNYVPYYYYGMDV

SEQ ID NO: 1451 - protein, 5 aa, Artificial Sequence
  Description of Artificial Sequence: Synthetic peptide
GATDV

SEQ ID NO: 1452 - protein, 15 aa, Artificial Sequence
  Description of Artificial Sequence: Synthetic peptide
DRLQDGNSWSDAFDV

SEQ ID NO: 1453 - protein, 15 aa, Artificial Sequence
  Description of Artificial Sequence: Synthetic peptide
EESSSGWYEGNWFDP

SEQ ID NO: 1454 - protein, 15 aa, Artificial Sequence
  Description of Artificial Sequence: Synthetic peptide
DRLQDGNSWSDAFDV

SEQ ID NO: 1455 - protein, 10 aa, Artificial Sequence
  Description of Artificial Sequence: Synthetic peptide
GRMDTAMAQI

SEQ ID NO: 1456 - protein, 8 aa, Artificial Sequence
  Description of Artificial Sequence: Synthetic peptide
DLDVSLDI

SEQ ID NO: 1457 - protein, 14 aa, Artificial Sequence
  Description of Artificial Sequence: Synthetic peptide
VHSSGYYHPGPNDY

SEQ ID NO: 1458 - protein, 9 aa, Artificial Sequence
  Description of Artificial Sequence: Synthetic peptide
EAGVVAVDY

SEQ ID NO: 1459 - protein, 13 aa, Artificial Sequence
  Description of Artificial Sequence: Synthetic peptide
EPLFGVVEEDVDY

SEQ ID NO: 1460 - protein, 11 aa, Artificial Sequence
  Description of Artificial Sequence: Synthetic peptide
GSGSLGDAFDI

SEQ ID NO: 1461 - protein, 12 aa, Artificial Sequence
  Description of Artificial Sequence: Synthetic peptide
DGFGELSGAFDI

SEQ ID NO: 1462 - protein, 13 aa, Artificial Sequence
  Description of Artificial Sequence: Synthetic peptide
GPIGCSGGSCLDY

SEQ ID NO: 1463 - protein, 12 aa, Artificial Sequence
  Description of Artificial Sequence: Synthetic peptide
GSYGDYGDAFDI

SEQ ID NO: 1464 - protein, 9 aa, Artificial Sequence
  Description of Artificial Sequence: Synthetic peptide
DHKVVRFGY

SEQ ID NO: 1465 - protein, 7 aa, Artificial Sequence
  Description of Artificial Sequence: Synthetic peptide
GDYYMDV

SEQ ID NO: 1466 - protein, 15 aa, Artificial Sequence
  Description of Artificial Sequence: Synthetic peptide
DGPIRYFDHSKAFDI

SEQ ID NO: 1467 - protein, 10 aa, Artificial Sequence
  Description of Artificial Sequence: Synthetic peptide
EMDDSSGPDY

SEQ ID NO: 1468 - protein, 14 aa, Artificial Sequence
  Description of Artificial Sequence: Synthetic peptide
GFLRGGDCCGALDI

SEQ ID NO: 1469 - protein, 13 aa, Artificial Sequence
  Description of Artificial Sequence: Synthetic peptide
GLDPLFAYDAFEI

SEQ ID NO: 1470 - protein, 10 aa, Artificial Sequence
  Description of Artificial Sequence: Synthetic peptide
DDFWSGSVDY

SEQ ID NO: 1471 - protein, 13 aa, Artificial Sequence
  Description of Artificial Sequence: Synthetic peptide
EDDSSGYTSPFDY

SEQ ID NO: 1472 - protein, 16 aa, Artificial Sequence
  Description of Artificial Sequence: Synthetic peptide
EPASSSWYGYYYYMDV

SEQ ID NO: 1473 - protein, 13 aa, Artificial Sequence
  Description of Artificial Sequence: Synthetic peptide
GDSNYWSYYGMDV

SEQ ID NO: 1474 - protein, 9 aa, Artificial Sequence
  Description of Artificial Sequence: Synthetic peptide
FSSSDSYDY

SEQ ID NO: 1475 - protein, 17 aa, Artificial Sequence
  Description of Artificial Sequence: Synthetic peptide
IYGGDRTNTQAPYFFDL

SEQ ID NO: 1476 - protein, 13 aa, Artificial Sequence
  Description of Artificial Sequence: Synthetic peptide
DYLELATYYGMDV

SEQ ID NO: 1477 - protein, 15 aa, Artificial Sequence
  Description of Artificial Sequence: Synthetic peptide
DLAAAGNYYYYGMDV

SEQ ID NO: 1478 - protein, 13 aa, Artificial Sequence
  Description of Artificial Sequence: Synthetic peptide
DDDFWSGSGAFDI

SEQ ID NO: 1479 - protein, 14 aa, Artificial Sequence
  Description of Artificial Sequence: Synthetic peptide
PEGVSYYDSSVLDY

SEQ ID NO: 1480 - protein, 12 aa, Artificial Sequence
  Description of Artificial Sequence: Synthetic peptide
GGYGDYLDAFDI

SEQ ID NO: 1481 - protein, 5 aa, Artificial Sequence
  Description of Artificial Sequence: Synthetic peptide
DYAFH

SEQ ID NO: 1482 - protein, 5 aa, Artificial Sequence
  Description of Artificial Sequence: Synthetic peptide
KYGMN

SEQ ID NO: 1483 - protein, 5 aa, Artificial Sequence
  Description of Artificial Sequence: Synthetic peptide
DYYMA

SEQ ID NO: 1484 - protein, 7 aa, Artificial Sequence
  Description of Artificial Sequence: Synthetic peptide
TYGMSVG

SEQ ID NO: 1485 - protein, 5 aa, Artificial Sequence
  Description of Artificial Sequence: Synthetic peptide
SSGMQ

SEQ ID NO: 1486 - protein, 7 aa, Artificial Sequence
  Description of Artificial Sequence: Synthetic peptide
THGMGVG

SEQ ID NO: 1487 - protein, 7 aa, Artificial Sequence
  Description of Artificial Sequence: Synthetic peptide
TSGMVVS

SEQ ID NO: 1488 - protein, 5 aa, Artificial Sequence
  Description of Artificial Sequence: Synthetic peptide
GYAMH

SEQ ID NO: 1489 - protein, 5 aa, Artificial Sequence
  Description of Artificial Sequence: Synthetic peptide
DYYMA

SEQ ID NO: 1490 - protein, 5 aa, Artificial Sequence
  Description of Artificial Sequence: Synthetic peptide
SSGMQ

SEQ ID NO: 1491 - protein, 5 aa, Artificial Sequence
  Description of Artificial Sequence: Synthetic peptide
DYAFH

SEQ ID NO: 1492 - protein, 5 aa, Artificial Sequence
  Description of Artificial Sequence: Synthetic peptide
KYGMN

SEQ ID NO: 1493 - protein, 7 aa, Artificial Sequence
  Description of Artificial Sequence: Synthetic peptide
TYGMSVG

SEQ ID NO: 1494 - protein, 7 aa, Artificial Sequence
  Description of Artificial Sequence: Synthetic peptide
THGMGVG

SEQ ID NO: 1495 - protein, 7 aa, Artificial Sequence
  Description of Artificial Sequence: Synthetic peptide
TSGMVVS

SEQ ID NO: 1496 - protein, 5 aa, Artificial Sequence
  Description of Artificial Sequence: Synthetic peptide
GYAMH

SEQ ID NO: 1497 - protein, 17 aa, Artificial Sequence
  Description of Artificial Sequence: Synthetic peptide
WINTYSGKPTYADDFKG

SEQ ID NO: 1498 - protein, 17 aa, Artificial Sequence
  Description of Artificial Sequence: Synthetic peptide
SISSTSIYIYYADTVKG

SEQ ID NO: 1499 - protein, 16 aa, Artificial Sequence
  Description of Artificial Sequence: Synthetic peptide
SISYEGNPYYGDSVKG

SEQ ID NO: 1500 - protein, 16 aa, Artificial Sequence
  Description of Artificial Sequence: Synthetic peptide
DIWWDDDKHYNPSLKN

SEQ ID NO: 1501 - protein, 17 aa, Artificial Sequence
  Description of Artificial Sequence: Synthetic peptide
GIYYDSYKKSYADSVKG

SEQ ID NO: 1502 - protein, 16 aa, Artificial Sequence
  Description of Artificial Sequence: Synthetic peptide
NIWWDDDKYYNPSLKN

SEQ ID NO: 1503 - protein, 16 aa, Artificial Sequence
  Description of Artificial Sequence: Synthetic peptide
AIAWDGDKYYNPSLKS

SEQ ID NO: 1504 - protein, 17 aa, Artificial Sequence
  Description of Artificial Sequence: Synthetic peptide
WINTYSGKPTYADDFKG

SEQ ID NO: 1505 - protein, 16 aa, Artificial Sequence
  Description of Artificial Sequence: Synthetic peptide
SISYEGNPYYGDSVKG

SEQ ID NO: 1506 - protein, 17 aa, Artificial Sequence
  Description of Artificial Sequence: Synthetic peptide
GIYYDSYKKSYADSVKG

SEQ ID NO: 1507 - protein, 17 aa, Artificial Sequence
  Description of Artificial Sequence: Synthetic peptide
WINTYSGKPTYADDFKG

SEQ ID NO: 1508 - protein, 17 aa, Artificial Sequence
  Description of Artificial Sequence: Synthetic peptide
SISSTSIYIYYADTVKG

SEQ ID NO: 1509 - protein, 16 aa, Artificial Sequence
  Description of Artificial Sequence: Synthetic peptide
DIWWDDDKHYNPSLKN

SEQ ID NO: 1510 - protein, 16 aa, Artificial Sequence
  Description of Artificial Sequence: Synthetic peptide
NIWWDDDKYYNPSLKN

SEQ ID NO: 1511 - protein, 16 aa, Artificial Sequence
  Description of Artificial Sequence: Synthetic peptide
AIAWDGDKYYNPSLKS

SEQ ID NO: 1512 - protein, 17 aa, Artificial Sequence
  Description of Artificial Sequence: Synthetic peptide
WINTYSGKPTYADDFKG

SEQ ID NO: 1513 - protein, 12 aa, Artificial Sequence
  Description of Artificial Sequence: Synthetic peptide
GAYYGYRDWFTY

SEQ ID NO: 1514 - protein, 8 aa, Artificial Sequence
  Description of Artificial Sequence: Synthetic peptide
HDYSSYSY

SEQ ID NO: 1515 - protein, 11 aa, Artificial Sequence
  Description of Artificial Sequence: Synthetic peptide
HDHNNVDWFAY

SEQ ID NO: 1516 - protein, 14 aa, Artificial Sequence
  Description of Artificial Sequence: Synthetic peptide
SSTTDGIVTYVMDV

SEQ ID NO: 1517 - protein, 12 aa, Artificial Sequence
  Description of Artificial Sequence: Synthetic peptide
SAYYGYKDYFDY

SEQ ID NO: 1518 - protein, 13 aa, Artificial Sequence
  Description of Artificial Sequence: Synthetic peptide
IEGSPVVTTVFDY

SEQ ID NO: 1519 - protein, 12 aa, Artificial Sequence
  Description of Artificial Sequence: Synthetic peptide
RDYDVGYYYFDF

SEQ ID NO: 1520 - protein, 12 aa, Artificial Sequence
  Description of Artificial Sequence: Synthetic peptide
STYYGYKDWFAY

SEQ ID NO: 1521 - protein, 11 aa, Artificial Sequence
  Description of Artificial Sequence: Synthetic peptide
HDHNNVDWFAY

SEQ ID NO: 1522 - protein, 12 aa, Artificial Sequence
  Description of Artificial Sequence: Synthetic peptide
SAYYGYKDYFDY

SEQ ID NO: 1523 - protein, 12 aa, Artificial Sequence
  Description of Artificial Sequence: Synthetic peptide
GAYYGYRDWFTY

SEQ ID NO: 1524 - protein, 8 aa, Artificial Sequence
  Description of Artificial Sequence: Synthetic peptide
HDYSSYSY

SEQ ID NO: 1525 - protein, 14 aa, Artificial Sequence
  Description of Artificial Sequence: Synthetic peptide
SSTTDGIVTYVMDV

SEQ ID NO: 1526 - protein, 13 aa, Artificial Sequence
  Description of Artificial Sequence: Synthetic peptide
IEGSPVVTTVFDY

SEQ ID NO: 1527 - protein, 12 aa, Artificial Sequence
  Description of Artificial Sequence: Synthetic peptide
RDYDVGYYYFDF

SEQ ID NO: 1528 - protein, 12 aa, Artificial Sequence
  Description of Artificial Sequence: Synthetic peptide
STYYGYKDWFAY

SEQ ID NO: 1529 - protein, 10 aa, Artificial Sequence
  Description of Artificial Sequence: Synthetic peptide
YCARGNWDDY

What is claimed is:

1. A method of treating a subject having a disease associated with expression of CD19, comprising administering to the subject an effective number of one or more cells that express a CAR molecule that binds CD19 in combination with an effective number of one or more cells that express a CAR molecule that binds CD22, wherein the CD22 CAR molecule comprises a CD22 binding domain comprising:
    (i) a light chain complementary determining region 1 (LC CDR1) of SEQ ID NO: 647, a light chain complementary determining region 2 (LC CDR2) of SEQ ID NO: 658, and a light chain complementary determining region 3 (LC CDR3) of SEQ ID NO: 669, and a heavy chain complementary determining region 1 (HC CDR1) of SEQ ID NO: 497 or SEQ ID NO: 1344, a heavy chain complementary determining region 2 (HC CDR2) of SEQ ID NO:508 or SEQ ID NO: 1353, and a heavy chain complementary determining region 3 (HC CDR3) of SEQ ID NO: 519 or SEQ ID NO: 1362; or
    (ii) a LC CDR1 of SEQ ID NO: 648, a LC CDR2 of SEQ ID NO:659, and a LC CDR3 of SEQ ID NO:670, and a HC CDR1 of SEQ ID NO:498 or SEQ ID NO: 1345, a HC CDR2 or SEQ ID NO: 509 or SEQ ID NO: 1354, and a HC CDR3 of SEQ ID NO: 520 or SEQ ID NO: 1363.

2. The method of claim 1, wherein the subject has relapsed or is identified as having relapsed after treatment with the one or more cells that express a CAR molecule that binds CD19.

3. The method of claim 2, wherein the subject has relapsed or is identified as having relapsed based on one or more of:
    (i) reappearance of blasts in the blood, bone marrow or any extramedullary site, after a complete response;
    (ii) detection of CD19− blasts above a predetermined threshold;
    (iii) an increase in RNA levels of one or more of MIR199A1, MIR1203, ITM2C, or HLA-DQB1 compared to a non relapser; or
    (iv) a decrease in RNA levels of one or more of PPIAL4D, TTTY10, TXLNG2P, MIR4650-1, KDM5D, USP9Y, PRKY, RPS4Y2, RPS4Y1, NCRNA00185, SULT1E1, and EIF1AY compared to a non-relapser.

4. The method of claim 1, further comprising performing lymphodepletion on that subject.

5. The method of claim 1, wherein the CD19 CAR comprises an antibody or antibody fragment which includes a CD19 binding domain, a transmembrane domain, and an intracellular signaling domain comprising a stimulatory domain, and wherein said CD19 binding domain comprises a light chain complementary determining region 1 (LC CDR1), a light chain complementary determining region 2 (LC CDR2), and a light chain complementary determining region 3 (LC CDR3) of any CD19 scFv or light chain binding domain amino acid sequence listed in Tables 2 or 3, and a heavy chain complementary determining region 1 (HC CDR1), a heavy chain complementary determining region 2 (HC CDR2), and a heavy chain complementary determining region 3 (HC CDR3) of any CD19 scFv or heavy chain binding domain amino acid sequence listed in Tables 2 or 3.

6. The method of claim 5, wherein the CD19 CAR molecule comprises a CD19 binding domain-comprising a LC CDR1 of SEQ ID NO: 25, a LC CDR2 of SEQ ID NO: 26 and a LC CDR3 of SEQ ID NO: 27; and a HC CDR1 of SEQ ID NO: 19; a HC CDR2 of SEQ ID NO: 20 and a HC CDR3 of SEQ ID NO: 24.

7. The method of claim 5, wherein the CD19 CAR molecule comprises a CD19 binding domain comprising a light chain variable region and a heavy chain variable region of SEQ ID NO: 59, or an amino acid sequence with at least 95% identity thereto.

8. The method of claim 5, wherein the CD19 CAR molecule comprises the amino acid sequence of SEQ ID NO: 58, or an amino acid sequence with at least 95% identity thereto.

9. The method of claim 5, wherein the CD19 CAR molecule comprises a CD19 binding domain comprising a LC CDR1 of SEQ ID NO: 25, a LC CDR2 of SEQ ID NO: 26 and a LC CDR3 of SEQ ID NO: 27; and a HC CDR1 of SEQ ID NO: 19; a HC CDR2 of any of SEQ ID NOs: 21-23 and a HC CDR3 of SEQ ID NO: 24.

10. The method of claim 5, wherein the CD19 CAR molecule comprises a CD19 binding domain comprising a light chain variable region and a heavy chain variable region of SEQ ID NO: 2, or an amino acid sequence with 95-99% identity thereto.

11. The method of claim 5, wherein the CD19 CAR molecule comprises the amino acid sequence of SEQ ID NO: 32, or an amino acid sequence with at least 95% identity thereto.

12. The method of claim 1, wherein the CD22 CAR molecule comprises a CD22 binding domain comprising:
(i) a light chain variable region of SEQ ID NO: 690, or a light chain variable region with 95-99% identity to the light chain variable region of SEQ ID NO: 690; and/or
(ii) a heavy chain variable region of SEQ ID NO: 680, or a heavy chain variable region with 95-99% identity to the heavy chain variable region of SEQ ID NO: 680.

13. The method of claim 12, wherein the CD22 binding domain comprises a (Gly$_4$-Ser)$_n$ linker, wherein n=1, 2, 3 or 4 (SEQ ID NO: 53).

14. The method of claim 1, wherein the CD22 CAR molecule comprises a CD22 binding domain comprising:
(i) a light chain variable region of SEQ ID NO: 690; and
(ii) a heavy chain variable region of SEQ ID NO: 680.

15. The method of claim 1, wherein the CD22 CAR molecule comprises the amino acid sequence of SEQ ID NO: 140, or an amino acid sequence with 95-99% identity thereto.

16. The method of claim 1, wherein the CD22 CAR molecule comprises a CD22 binding domain comprising:
(i) a light chain variable region of SEQ ID NO: 689 or an amino acid sequence with 95-99% identity thereto; and/or
(ii) a heavy chain variable region of SEQ ID NO: 679, or an amino acid sequence with 95-99% identity thereto.

17. The method of claim 1, wherein the CD19 CAR molecule or CD22 CAR molecule comprises a transmembrane domain that comprises a transmembrane domain of a protein selected from the group consisting of the alpha, beta or zeta chain of the T-cell receptor, CD28, CD3 epsilon, CD45, CD4, CD5, CD8, CD9, CD16, CD22, CD33, CD37, CD64, CD80, CD86, CD134, CD137 and CD154.

18. The method of claim 1, wherein the CD19 CAR molecule or CD22 CAR molecule comprises an antigen binding domain that is connected to the transmembrane domain by a hinge region.

19. The method of claim 1, wherein the CD19 CAR molecule or CD22 CAR molecule comprises a costimulatory domain comprising a functional signaling domain obtained from a protein selected from the group consisting of OX40, CD2, CD27, CD28, CDS, ICAM-1, LFA-1 (CD11a/CD18), ICOS (CD278), and 4-1BB (CD137).

20. The method of claim 1, wherein the CD19 CAR molecule or CD22 CAR molecule comprises an intracellular signaling domain, wherein the intracellular signaling domain comprises:
(i) a functional signaling domain of 4-1BB, a functional signaling domain of CD3 zeta, or a combination thereof;
(ii) the amino acid sequence of SEQ ID NO: 16, SEQ ID NO:17 or SEQ ID NO:43; or
(iii) the amino acid sequence of SEQ ID NO: 16, and the amino acid sequence of SEQ ID NO:17 or SEQ ID NO:43.

21. The method of claim 1, wherein:
(a) the disease associated with CD19 expression is selected from:
(i) a proliferative disease comprising a cancer, tumor or malignancy;
(ii) a precancerous condition comprising a myelodysplasia, a myelodysplastic syndrome or a preleukemia;
(iii) a non-cancer related indication; or
(iv) one or more of a hematologic cancer, acute leukemia, B-cell acute lymphoid leukemia (BALL), T-cell acute lymphoid leukemia (TALL), small lymphocytic leukemia (SLL), acute lymphoid leukemia (ALL); chronic leukemia, chronic myelogenous leukemia (CML), chronic lymphocytic leukemia (CLL), non-Hodgkin lymphoma, multiple myeloma, or myeloma; or
(b) the disease is a CD19-negative cancer.

22. The method of claim 1, further comprising administering:
an agent that increases the efficacy of a cell expressing a CAR molecule,
an agent that ameliorates one or more side effects associated with administration of a cell expressing a CAR molecule,
an agent that treats the disease associated with CD19; or
a checkpoint inhibitor.

23. The method of claim 1, wherein the subject comprises a CD19-negative cancer cell, and a cancer cell that is positive for CD22.

24. The method of claim 1, wherein:
(i) the CD19 CAR-expressing cell is administered to the subject who is about to receive the CD22 CAR-expressing cell; or
(ii) the CD19 CAR-expressing cell and the CD22 CAR-expressing cell are administered concurrently.

25. The method of claim 2, wherein reappearance of blasts in the bone marrow comprises at least or more than 5% blasts in the bone marrow.

26. A method of treating a subject having a hematological cancer, comprising administering to the subject an effective number of: one or more cells that express a CAR molecule that binds CD19 in combination with one or more cells that express a CAR molecule that binds CD22, wherein:
(a) the CD22 CAR molecule comprises a CD22 binding domain comprising a light chain complementary determining region 1 (LC CDR1) of SEQ ID NO: 648, a light chain complementary determining region 2 (LC CDR2) of SEQ ID NO: 659, and a light chain complementary determining region 3 (LC CDR3) of SEQ ID NO: 670, and a heavy chain complementary determining region 1 (HC CDR1) of SEQ ID NO: 498 or SEQ ID NO: 1345, a heavy chain complementary determining region 2 (HC CDR2) of SEQ ID NO:509 or SEQ ID NO: 1354, and a heavy chain complementary determining region 3 (HC CDR3) of SEQ ID NO: 520 or SEQ ID NO: 1363; and
(b) the CD19 CAR molecule comprises a CD19 binding domain comprising:
(i) a LC CDR1 of SEQ ID NO: 25, a LC CDR2 of SEQ ID NO: 26 and a LC CDR3 of SEQ ID NO: 27; and a HC CDR1 of SEQ ID NO: 19; a HC CDR2 of SEQ ID NO: 20 and a HC CDR3 of SEQ ID NO: 24; or
(ii) a LC CDR1 of SEQ ID NO: 25, a LC CDR2 of SEQ ID NO: 26 and a LC CDR3 of SEQ ID NO: 27; and a HC CDR1 of SEQ ID NO: 19; a HC CDR2 of any of SEQ ID NOs: 21-23 and a HC CDR3 of SEQ ID NO: 24.

27. The method of claim 26, wherein the CD22 CAR molecule comprises a CD22 binding domain comprising:
(i) a light chain variable region of SEQ ID NO: 690, or a light chain variable region with 95-99% identity to the light chain variable region of SEQ ID NO: 690; and/or
(ii) a heavy chain variable region of SEQ ID NO: 680, or or a heavy chain variable region with 95-99% identity to the heavy chain variable region of SEQ ID NO: 680.

28. The method of claim 26, wherein:
(a) the CD19 CAR molecule comprises a CD19 binding domain comprising:
(i) a light chain variable region and a heavy chain variable region of SEQ ID NO: 59, or an amino acid sequence with at least 95% identity thereto; or
(ii) a light chain variable region and a heavy chain variable region of SEQ ID NO: 2, or an amino acid sequence with 95-99% identity thereto; and
(b) the CD22 CAR molecule comprises a CD22 binding domain comprising:
(i) a light chain variable region of SEQ ID NO: 690 or an amino acid sequence with 95-99% identity thereto; and a heavy chain variable region of SEQ ID NO: 680, or an amino acid sequence with 95-99% identity thereto; and
(ii) a linker of SEQ ID NO:53.

29. The method of claim 26, wherein:
(a) the CD19 CAR comprises the amino acid sequence of SEQ ID NO: 32, or an amino acid sequence with at least 95% identity thereto; and
(b) the CD22 CAR comprises the light chain variable region of SEQ ID NO: 690 or an amino acid sequence with 95-99% identity thereto; and a heavy chain variable region of SEQ ID NO: 680, or an amino acid sequence with 95-99% identity thereto; and a linker of SEQ ID NO:53.

30. The method of claim 26, wherein:
(a) the CD19 CAR comprises the amino acid sequence of SEQ ID NO: 32; and
(b) the CD22 CAR comprises the light chain variable region of SEQ ID NO: 690, and a heavy chain variable region of SEQ ID NO: 680, and a linker of SEQ ID NO:53.

31. The method of claim 26, wherein:
(a) the CD19 CAR comprises the amino acid sequence of SEQ ID NO: 58, or an amino acid sequence with at least 95% identity thereto; and
(b) the CD22 CAR comprises the light chain variable region of SEQ ID NO: 690 or an amino acid sequence with 95-99% identity thereto; and a heavy chain variable region of SEQ ID NO: 680, or an amino acid sequence with 95-99% identity thereto; and a linker of SEQ ID NO:53.

32. The method of claim 26, wherein:
(a) the CD19 CAR comprises the amino acid sequence of SEQ ID NO: 58 and
(b) the CD22 CAR comprises the light chain variable region of SEQ ID NO: 690, and a heavy chain variable region of SEQ ID NO: 680, and a linker of SEQ ID NO:53.

33. The method of claim 26, wherein the hematologic cancer is chosen from acute leukemia, B-cell acute lymphoid leukemia (BALL), T-cell acute lymphoid leukemia (TALL), small lymphocytic leukemia (SLL), acute lymphoid leukemia (ALL); chronic leukemia, chronic myelogenous leukemia (CML), chronic lymphocytic leukemia (CLL), non-Hodgkin lymphoma, multiple myeloma, or myeloma.

34. The method of claim 1, wherein the CAR molecule that binds CD19 and the CAR molecule that binds CD22 are expressed in the same cell.

35. The method of claim 1, wherein the CAR molecule that binds CD19 and the CAR molecule that binds CD22 are expressed in different cells.

* * * * *